United States Patent 9,572,897 (MODIFIED POLYNUCLEOTIDES FOR THE PRODUCTION OF CYTOPLASMIC AND CYTOSKELETAL PROTEINS) - sequence listing, part 4

SEQ ID NO: 2570 - DNA, 3643 bp, Homo sapiens
gggagagggaaggtcaggcttgcctcctgttcacaaggacaacctctgtctcccttgtggcggcttctatgaaggtggggactccaggctttctctcgtctgctttttggatgccttcaagagaggccagttagaggatatcaattgtggcaattccccagagccctcatcagatggcattagcccgtcatgtgctgcagtggcacccagtttggaggaaattcggaaccagaagagtgtgacagtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcgccatgccgggcgagacggtgctcaatggcaaccaggagtgggtggtgcaggcggacctcccgctgaccgcagccatccggcagagtcaacagactctctaccactcacacccccctcaccctgcggaccggcaagcggtcagggtgagcccctgccactcccggcagccctctgtcatctccgacgcatctgccgccgaaggcgaccggtcgtccacaccgagcgacatcaactcccctcgacaccggacacactccctctgcaacggcgacagtcccggcccagttcagaagaacctgcacaaccctattgtacagtcactagaggatcttgaagaccaaaaacggaaaaagaagaaagagaagatgggattcggctccatctcccgcgtcttcgccagagggaagcagcggaagtccctcgaccccggcctctttgatggtaccgcccctgattattacatagaggaggacgcggactggtgatacgcgctcccctgcgcctgctgcccgcaggcgtgtctgtgcgtgtgggcgtgtgtgcaagcgagcgtgggtgcgcgtgtggccgtgcgtggggtgcgtgtgcacgtgtgcgctggcacacatgggtgctgggtgtggccgagcgcctctaacaagtgaaaacacgagtgtgaacctctctcccctgcgtcgccacctctgtaattgatgtacataccgcaaaccgtgtgtgaacctgtcaactctctgtcgtctttggagcgatacagttgtgttgttaatctggtttattatttttcttcagtgtttggtttttctttttctttttgtttggttcgtcggtttgtttttgtttttgtttttttccccctttctcctcccctcctcctttttatgaaacttgaaaacttgaaggactgctgtgtatttgtaaataacaaaactattgtgcactctgtgcttgtaaatgtccctcgtccaaaccgctactcctggagcccgtctggcagaggatgtggtctgtttttgatgtcccccctcccgcccccctggtgtgaacgtgtgggaccagaccctgtcctgggggtgcgcccaagtcactttaaccacaaaacgccatcgtcgtcagggtaagctctgctctctacaaagactcgcgagccgggccaaggggccttgtcttggctgggtttgtcagaggtcaaaccggctcttttaaacggcctaccagtttttaaattgcattgccgtttctttctttatgaaaaaaaagaaaaaaagaaaattgtttcatttaatttatttgcacaaatgctgaaaacttattctatctaaattattacataaatattggaatgtctatttttccatggggtgggcgggaggtgggtgtctctgttgacttgtctgttctgttaccatgctgctacccaactgtgcaaagtagtttagggtggccagaacccagggaccattggatttcaaagcttgctttttctgttggttcttctctctccttctctctctgtctctcccattctcctgcccatgcatgaaaggatcctccaccttcttcccacccagagctccctccaggcctttctctatatatttatttatctgacatacagaacacgactttagtgagcagagtgctgacagtcatggtccccttctttgggtctgtcttttgagagaggttgagttcagggcaagacagcctgccacacatccaagggtacgaccagtgggaccctggcctgagtctgttctccgaggggcctccagcagcttctgttcctccctgcagctgtgtctttcttgtcctgggtttaggatgcaggtgggccaggcaggtgttgttaggggaggcacccacttcaaaaggagggccacagtggggacacagagtccagcacctgagccctccaccctccccattctggttggttccatcagccacacttagaatctcccaggatcccttggactccgtcccccaacttgtcacagcagcctgagcctacccaccccaggagacaagagctggcaggaacatctgcctatatggggggtggcgttggccccaaagaggcttcaccagcaaaggaactgtgtgtattttaatgccaggggacggaggatgtgtgagctgttcagcaaggtctgcccaaggcctaaaactcaatttccttattcttttgcttctgctcgtccttaacaactaacagctcaacccacacctctagacaacagtagtcgtgctttctgctaacggtgacattttcagctcttaaaaagaagcaaggagattttcaaatgctagagtatctctatcagaaggcataggacattgtgtccaaagtctcaagaacaaacaacactttccttctgacctggtccaaaagtcagcaaacagcaagcaggcagaggccctcataaggacttttctgtcctcctttgaccaaactgtttaaccgagcctaggggtgacggggagcgacccaagctggcatctttctctacggagacagattttagaaaatacttttcttgcccatgaatttcttttctggttgatttttatcattttccctttacttacaagaaaataagattgcaaccactcctgctaatgatttagtagttccttttcatttcagtttttgtaaattaggagataattctaagagttactaaaggatgatttatttaagagaactacgtcaaatagcgaatgagttatgggtaacattagacgaaaataacctttcccgtgggaaaggtttctcgaaggcatggatgcaaatataaaatattaaaaaaaatctaaataaagcttattttaaaatatgatcg

SEQ ID NO: 2571 - DNA, 984 bp, Homo sapiens
cctgggacacggagcttgcagtgagctgatacggtgccactgcactccagcctgggcaacagagtgagactccgtctcaaaaaaaaaaatcagatttttaggaattacacattagtggagtagttagcagagcccatttttctgagaattaggctctaacttttagttgtaatttagataagttccaaaataagtttttaaacatttaagcttctttgcatgattttatccatttacgttattcaggataagcatctatttgtttatcaagtaatgttttctttcaactttgttttttgtggcagatgtttataaattcttctgtgggatcagagggcacgcctattacaaccagaaaactacaagtataacagcgaggatggatgaacaggctctattagggctaaatccaaatgctgattcagactttagacaaagggccctggcctattttgagcagttaaaaatttccccagatgcctggcaggtgtgtgcagaagctctagcccagaggacatacagtgatgatcatgtgaagtttttctgctttcaagtactggaacatcaagttaaatacaaatactcagaactaaccactgttcaacaacagctaattagggagacgctcatatcatggctgcaagctcagatgctgaatccccaaccagagaagacctttatacgaaataaagccgcccaagtcttcgccttgctttttgttacagagtatctcactaagtggcccaagtttttttttgacattctctcagtagtggacctaaatccaaggggagtagatctctacctgcgaatcctcatggctattgattcagagttggtggatcgtgatgtggtgcatacatcagaggaggctcgtaggaatactctcataaaagataccatgagggaacagtgcattccaaatctggtggaatcatggtaccaaatattacaaaattatcagtttactaattctgaagtgac

SEQ ID NO: 2572 - DNA, 2048 bp, Homo sapiens
agttgtcgggtcttattggccgctgattagaccagccggggtccactagccctgggcttcagggaggctgctgcgtccagtgaacacttcagcacctgtagcacagaagggccaaggagctgcagtcctcgaccagcaggaggtttgctcctcagcccactcgctgcatccagatcagctcacccctctcccttccctgcccaccaggactctgatagcccctggcagccacagcccattttgccaagatgtctagagtagccaaatatcgccggcaggtgagtgaagaccccgacatcgacagcctgctggagaccctgtctcccgaggagatggaggagctggagaaggagctggacgtggtggacccagacgggagtgttcccgtggggctgcggcagagaaaccagacggagaaacagtccacgggtgtgtacaaccgggaggccatgctcaacttctgtgaaaaggagaccaagaaacttatgcagagggagatgtccatggatgaaagcaagcaagtggagaccaagacagatgccaagaatggagaggaaaggggcagagatgccagcaaaaaagccctgggccccagacgggactcagatctggggaaggagccaaagaggggtggtttaaagaaaagcttctctagagacagagatgaagctggtggcaagagtggcgagaagcccaaggaggagaagatcatccggggcattgacaagggccgggtcagggctgcagtggataagaaggaggcagggaaggatgggagaggagaggagagggcagtggccaccaagaaggaagaggagaagaaagggagtgacaggaacacaggcttgagcagggacaaggataaaaagagagaggagatgaaggaggtggccaagaaagaggatgatgagaaggtaaaaggggagcgtaggaacacagacaccagaaaagagggtgagaagatgaaaagagcaggtgggaacacagacatgaaaaaggaggatgagaaggtaaaaagaggaactgggaacacagacaccaaaaaggacgatgaaaaagtcaagaagaatgaacccttacatgaaaaggaagccaaggatgacagcaagaccaaaacacccgagaaacagacgcccagtggccccaccaagccctctgaaggaccggccaaggtggaggaggaggcagctcccagcatatttgatgagcctctggagagagtgaagaacaatgaccccgagatgactgaggtgaacgtcaacaactcagactgcatcacaaatgagatcttggtccggtttactgaggctctggagttcaacactgtggttaagctgttcgccttggccaacacgcgagccgatgaccacgtggcctttgccattgccatcatgctcaaggccaacaagaccatcaccagcctcaacctggactccaaccacatcacaggcaaaggcatcctggccatcttccgggccctcctccagaacaacacgctgaccgagctccgcttccacaaccagcgacacatctgtggaggcaagacggagatggagatcgccaagctgctgaaggagaatactaccctgctcaagctgggctaccattttgagctggccgggccccgaatgactgtcaccaatctgctcagccgcaacatggacaagcagagacaaaagcggctgcaggagcaaaggcaggcacaggaagccaagggagagaagaaggatctgctggaggtacccaaggccggggccgtggctaagggctccccaaaaccttcacctcaaccatctccaaagccctctccaaagaactcacccaaaaaagggggtgctccagctgccccaccaccccctccccctcccttggctccaccccttatcatggagaacctgaagaattcactctcaccagctacccagaggaagatgggagacaaagtcctccctgcccaggagaagaactcccgtgaccagctattggctgccatccgctccagcaacctcaagcagctcaagaagctagagcttccactgttgcttcag

SEQ ID NO: 2573 - DNA, 886 bp, Homo sapiens
gttgcctaaacctctgccacccacctgtgaacttcactttgccacagggaggcactgaactgaaaaactgccttgtaagaggtgtcgcccctctgtctactccctttcttatatcaagaggggaaaaacacgtaactacctctacccgatctggtcaccatacgcctattacctttactgttacaagtaccggatcactctccgggagaagatgctgcctcgttgttataaaagcatcacttataaggaagaggaggacttgacactccagccccgttcctgcctccagtgctcctgagtccctagtaggcctccaggagggcaaaagcaccgagcagggtaaccacgaccagcttaaagaactgtattcggctgggaacttgacggtgctggctactgaccccctgctccaccaggacccagtacagttagactttcacttccgccttacctcccagacctctgcccattggcacggccttctctgtgaccgtcgactcttcttggatatcccatatcaggccttggatcaaggcaaccgggaaagtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatc

SEQ ID NO: 2574 - DNA, 2539 bp, Homo sapiens
gcctccccagcgtcggctccccggcgggcggtgcgggccctcccactctaccccgcgccgtctcacggccccggccctagcttcaccccgactacccggcgtgcgcgtcctcctgccggcctgcaggcccggggcctccgcctgcttccccacagctgctccttgcggccccgcttgcgttcacgctgtcgcccgggccggcgcggccgcgggcaaccgctccccctcccacacctaccccgccccctccccgccttttccgccctccggtccccctccctcggcccgctgctgctgctccagatgaggtgatggcaacggccaacttcggcaagatccagatcgggatttacgtggagatcaagcgcagcgatggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttcaagagataatagagtggttggttcagcacgtgcacggcccagtcaatttcctgaacagtcttcctctgcacaacagaatggtagtgtttcagatatatctccagttcaagctgcaaaaaaggaatttggacccccttcacgtagaaaatctaattgtgtgaaagaagtagaaaaactgcaagaaaaacgagagaaaaggagattgcaacagcaagaacttagagaaaaaagagcccaggacgttgatgctacaaacccaaattatgaaattatgtgtatgatcagagactttagaggaagtttggattatagaccattaacaacagcagatcctattgatgaacataggatatgtgtgtgtgtaagaaaacgaccactcaataaaaaagaaactcaaatgaaagatcttgatgtaatcacaattcctagtaaagatgttgtgatggtacatgaaccaaaacaaaaagtagatttaacaaggtacctagaaaaccaaacatttcgttttgattatgcctttgatgactcagctcctaatgaaatggtttacaggtttactgctagaccactagtggaaactatatttgaaaggggaatggctacatgctttgcttatgggcagactggaagtggaaaaactcatactatgggtggtgacttttcaggaaagaaccaagattgttctaaaggaatttatgcattagcagctcgagatgtctttttaatgctaaagaagccaaactataagaagctagaacttcaagtatatgcaaccttctttgaaatttatagtggaaaggtgtttgacttgctaaacaggaaaacaaaattaagagttctagaagatggaaaacagcaggttcaagtggtgggattacaggaacgggaggtcaaatgtgttgaagatgtactgaaactcattgacataggcaacagttgcagaacatccggtcaaacatctgcaaatgcacattcatctcggagccatgcagtgtttcagattattcttagaaggaaaggaaaactacatggcaaattttctctcattgatttggctggaaatgaaagaggagctgatacttccagtgcggacaggcaaactaggcttgaaggtgctgaaattaataaaagccttttagcactcaaggagtgcatcagagccttaggtagaaataaacctcatactcctttccgtgcaagtaaactcactcaggtgttaagagattctttcataggtgaaaactctcgtacctgcatgattgccacaatctctccaggaatggcatcctgtgaaaatactcttaatacattaagatatgcaaatagggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgaagaagaagtctctccacagttgtttactttccacgaagctgtttcacaaatggtagaaatggaagaacaagttgtagaagatcacagggcagtgttccaggaatctattcggtggttagaagatgaaaaggccctcttagagatgactgaagaagtagattatgatgtcgattcatatgctacacaacttgaagctattcttgagcaaaaaatagacattttaactgaactgcgggataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttcagctgtaagggccatttgaaagtttggaattttaagtgtctgtggaaa

SEQ ID NO: 2575 - DNA, 2251 bp, Homo sapiens
gggacaccggggcgggggcaccgggaggaagctgccttggaagaggtgggggcggcgacgggaggggcggcgagcccccgggagcctgggcgttaggcccgggcgtggcggggccccggcggcctggggggtctcctgggcccccccccacccatggagcccgccgccccggaggtcggtctcagatgactgaactgggcaccgagcgcccctggtgtccctcgcagtggactgacgccgcaggggcgagctagccggctccgcgcctctccgcgggatccagacgcctcctggggctgctggcggagggtctgaggcggcgcggccatggctcacctccggggatttgccaaccagcactctcgagtggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcagtcagtgcgacagcccctacatcacccgctactttggctcctacctaaagagcaccaagctatggatcatcatggagtacctgggcggcggctcagcactggacttgcttaaaccaggtcccctggaggagacatacattgccacgatcctgcgggagattctgaagggcctggattatctgcactccgaacgcaagatccaccgagacatcaaagctgccaacgtgctactctcggagcagggtgacgtgaagctggcggactttggggtagcagggcagctcacagacacgcagattaagaggaacacattcgtgggcacccccttctggatggcacctgaggtcatcaagcagtcggcctacgacttcaaggctgacatctggtccctggggatcacagccatcgagctggccaagggggagcctccaaactctgacctccaccccatgcgcgtcctgttcctgattcccaagaacagcccacccacactggagggccagcacagcaagcccttcaaggagttcgtggaggcctgcctcaacaaagacccccgattccggcccacggccaaggagctcctgaagcacaagttcatcacacgctacaccaagaagacctccttcctcacggagctcatcgaccgctataagcgctggaagtcagaggggcatggcgaggagtccagctctgaggactctgacattgatggcgaggcggaggacggggagcagggccccatctggacgttcccccctaccatccggccgagtccacacagcaagcttcacaaggggacggccctgcacagttcacagaagcctgcggagcccgtcaagaggcagccgaggtcccagtgcctgtccacgctggtccggcccgtcttcggagagctcaaagagaagcacaagcagagcggcgggagcgtgggtgcgctggaggagctggagaacgccttcagcctggccgaggagtcctgccccggcatctcagacaagctgatggtgcacctggtggagcgagtgcagaggttttcacacaacagaaaccacctgacatccacccgctgaagcgcactgctgttcagataggggacggaaggtcgtttgtttttgttctgagctccataagaactgtgctgacttggaaggtgccctgtgctatgtcgtgcctgcagggacacgtcggatcccgtgggcctcacatgccaggtcaccaggtcaccgtctccttccacccctgcagtgtgctgttgtgcacgtcagggacgctgttctctatgcccactgccctcctccctctcctggcccagcagtattgctcacgggggctccagccgccggcgtggccctcatgagctacgcctgggtcttctgcagactcatgcagccctatggccgctcagaccaaggcgcagagcaactatcagggcagctctgcctcctcctcccatgaggtggggagaggcaacagggcagcccccagaggagtgtcctggccgctgtcctcccggggcccatgatggccatagatttgccttgtggtgttggatcaggtactgtgtctgctcataagtacttgtgtcatccagaatgttttgttttttaagaaaattgaattacttgtttcctgaaatattctgaggttaatatgttagttttcatagaacattgagaggcccctgccactttcaataaagacctgacttggaga

SEQ ID NO: 2576 - DNA, 1685 bp, Homo sapiens
gcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagctgcagccttcacatctggcctgccccgacgtcctgaacctgtccctaggtgagagctgccaagtccaggtggggtccctcggagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagtgttctctcgacactgccagccccgtgttagcacctgggcctcagtcccacttgctcccaggcgccggttctgtggttggtttggaattaaagtcctgtttgaagttgtc

SEQ ID NO: 2577 - DNA, 1883 bp, Homo sapiens
ggtcagacatgccagcagggttggaaagaggcaggtacggaagctgagctgcagagttagccggcatctgacagaaaaatgtgagtgtgctgtggaaggcttgcatttcctttaaggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagctcgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccgggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagcacccttaatgtcccgagcaaccccgcccagtctgcgcagtcacagtccagctacaaccccttcgaggatgaggacgacacgggcagcaccgtcagtgagaaggacgacactaaggccaaaaatgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagcc

SEQ ID NO: 2578 - DNA, 3355 bp, Homo sapiens
acactgtcctctcacagaacaagaaggtatctggtctacaagaactcgaggcctcactgaaacggaaagcaaatacaaagaaactttattttaaaaacatgtcttggtctcccaagaagagggcaattggattgctcagccagaatgaagagtagttttacagaaaaaagaggacaatattgggatcacctttgacctttccatttggaaataatattttctattgtgttatagaaaggtgggaagctttcatccagaacaatgaatttcataaaggacaatagccgagcccttattcaaagaatgggaatgactgttataaagcaaatcacagatgacctatttgtatggaatgttctgaatcgcgaagaagtaaacatcatttgctgcgagaaggtggagcaggatgctgctagagggatcattcacatgattttgaaaaagggttcagagtcctgtaacctctttcttaaatcccttaaggagtggaactatcctctatttcaggacttgaatggacaaagtctttttcatcagacatcagaaggagacttggacgatttggctcaggatttaaaggacttgtaccataccccatcttttctgaacttttatccccttggtgaagatattgacattatttttaacttgaaaagcaccttcacagaacctgtcctgtggaggaaggaccaacaccatcaccgcgtggagcagctgaccctgaatggcctcctgcaggctcttcagagcccctgcatcattgaaggggaatctggcaaaggcaagtccactctgctgcagcgaattgccatgctctggggctccggaaagtgcaaggctctgaccaagttcaaattcgtcttcttcctccgtctcagcagggcccagggtggactttttgaaaccctctgtgatcaactcctggatatacctggcacaatcaggaagcagacattcatggccatgctgctgaagctgcggcagagggttcttttccttcttgatggctacaatgaattcaagccccagaactgcccagaaatcgaagccctgataaaggaaaaccaccgcttcaagaacatggtcatcgtcaccactaccactgagtgcctgaggcacatacggcagtttggtgccctgactgctgaggtgggggatatgacagaagacagcgcccaggctctcatccgagaagtgctgatcaaggagcttgctgaaggcttgttgctccaaattcagaaatccaggtgcttgaggaatctcatgaagacccctctctttgtggtcatcacttgtgcaatccagatgggtgaaagtgagttccactctcacacacaaacaacgctgttccataccttctatgatctgttgatacagaaaaacaaacacaaacataaaggtgtggctgcaagtgacttcattcggagcctggaccactgtggagacctagctctggagggtgtgttctcccacaagtttgatttcgaactgcaggatgtgtccagcgtgaatgaggatgtcctgctgacaactgggctcctctgtaaatatacagctcaaaggttcaagccaaagtataaattctttcacaagtcattccaggagtacacagcaggacgaagactcagcagtttattgacgtctcatgagccagaggaggtgaccaaggggaatggttacttgcagaaaatggtttccatttcggacattacatccacttatagcagcctgctccggtacacctgtgggtcatctgtggaagccaccagggctgttatgaagcacctcgcagcagtgtatcaacacggctgccttctcggactttccatcgccaagaggcctctctggagacaggaatctttgcaaagtgtgaaaaacaccactgagcaagaaattctgaaagccataaacatcaattcctttgtagagtgtggcatccatttatatcaagagagtacatccaaatcagccctgagccaagaatttgaagctttctttcaaggtaaaagcttatatatcaactcagggaacatccccgattacttatttgacttctttgaacatttgcccaattgtgcaagtgccctggacttcattaaactggacttttatgggggagctatggcttcatgggaaaaggctgcagaagacacaggtggaatccacatggaagaggccccagaaacctacattcccagcagggctgtatctttgttcttcaactggaagcaggaattcaggactctggaggtcacactccgggatttcagcaagttgaataagcaagatatcagatatctggggaaaatattcagctctgccacaagcctcaggctgcaaataaagagatgtgctggtgtggctggaagcctcagtttggtcctcagcacctgtaagaacatttattctctcatggtggaagccagtcccctcaccatagaagatgagaggcacatcacatctgtaacaaacctgaaaaccttgagtattcatgacctacagaatcaacggctgccgggtggtctgactgacagcttgggtaacttgaagaaccttacaaagctcataatggataacataaagatgaatgaagaagatgctataaaactagctgaaggcctgaaaaacctgaagaagatgtgtttatttcatttgacccacttgtctgacattggagagggaatggattacatagtcaagtctctgtcaagtgaaccctgtgaccttgaagaaattcaattagtctcctgctgcttgtctgcaaatgcagtgaaaatcctagctcagaatcttcacaatttggtcaaactgagcattcttgatttatcagaaaattacctggaaaaagatggaaatgaagctcttcatgaactgatcgacaggatgaacgtgctagaacagctcaccgcactgatgctgccctggggctgtgacgtgcaaggcagcctgagcagcctgttgaaacatttggaggaggtcccacaactcgtcaagcttgggttgaaaaactggagactcacagatacagagattagaattttaggtgcattttttggaaagaaccctctgaaaaacttccagcagttgaatttggcgggaaatcgtgtgagcagtgatggatggcttgccttcatgggtgtatttgagaatcttaagcaattagtgttttttgactttagtactaaagaatttctacctgatccagcattagtcagaaaacttagccaagtgttatccaagttaacttttctgcaagaagctaggcttgttgggtggcaatttgatgatgatgatctcagtgttattacaggtgcttttaaactagtaactgcttaaataaagtgtactcgaagcc

SEQ ID NO: 2579 - DNA, 543 bp, Homo sapiens
caggcggcggagcctccgggacggcgagcggcgggcggcggaggaggagacggcagactgaccaaatatggaagtgtgcaagtcttgaacacattagtttatacaatgtggcctgaaagtttccctcctctttccaaatcaaccataatattctgaggcattaaaaaatatttaatcattcatgtgttgagactcattcttgagttatggatgacaaggcttctgttggaaaaatcagtgtctcttcagactcagtatctactcttaatagtgaagattttgtcttggtttccaggcaaggagatgagacaccatctacaaataatggaagtgatgatgagaaaacaggactcaagattgtagggaatggaagtgaacagcagctgcaaaaagagctagcagatgtactgatggatcctccaatggacgaccagccaggggaaaaggagcttgtgaaaaggtcacaactggatggtgaaggagatgggcctctttctaatcagctctccgcttcatccaccattaaccctgtgccattagtag

SEQ ID NO: 2580 - DNA, 1002 bp, Homo sapiens
gtgcccacaggcctgcagcgggtccaaacctcaggcccccagcccgtgccgcttcgcggggtccacttctcgggaaatgtcctccgagccgcctgctggcggtgtcccgatccccccgggagtgggtcgaagggccaggccctccccagggggtgctgtgcctagggctcgactgtccgctctctctccctgcgcagctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacagtctccagaacacagaggagtccctgcgccatgtggatgccagcttcttcttggggaaggtgtgtttcctcgccacaggtgctgggcgggagagccactgcagcattcaccggcacaccgtggtgaagctggcccacacctatcaaagccccctgctctactgtgacctggaggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaagtttaaaaatca

SEQ ID NO: 2581 - DNA, 2331 bp, Homo sapiens
atggcctcggacacccaggcagtccctgacgtgtcggggaggagccgggcgcggaggtacgctgagtggagctcggggctgcgtagtggccgggccggcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaaggggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctccgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcac

SEQ ID NO: 2582 - DNA, 1606 bp, Homo sapiens
gggtttgaatccccggcggcggcgcggggcggccgcggaccgtgagtcagcattggcggcggccccagcgcgtggcagccgtgcgccgccaaggttctgcgttagacctgcatcttagcaatgtgaatattgcatccctagagaaggacctggaagagcaagacggccacgacctgggagcagcaggtcccaggtcgctggccggctctgcacctgtcgccatccccggctccctgcccagagcaccatcgctacactcgccatcctctgcgtccacctcgccgctcggttcgctgtcccagcccctcccagggccggtgggctcctcagccatgacgcctccccagcagccgccacccctgcgttcagagccgggcacactgggctctgcagcctcatcctacagccccctaggtttgaacggtgtccccgggagcatctgggactttgtttccggcagcttctcccccagcccctcccccatcctgagtgccggccccccatcctcttcgagtgcaagtccaaacggagctgagctggcccgggtcaggcggcagctggacgaggccaagaggaagatccggcagtgggaggagtcctggcagcaggtgaagcaggtctgcgatgcctggcagcgagaggcgcaggaggccaaggagcgtgcccgtgtggccgatagcgaccggcagctggcgctgcagaagaaggaggaggtggaggcacaggtgaagcagctgcaggaggagctggagggcctgggcgtagcctccacactgccggggctgcggggctgtggggacatcggcaccattcccctgccgaagctgcactcgctgcagagtcagctgcgcctggacctggaggcggtggacggcgtgatcttccagctccgcgccaagcagtgtgtggcctgccgggagcgggcccacggtgctgtcctgcggccctgtcagcaccacatcctctgtgagccgtgtgcggccaccgcacctgagtgcccctactgcaagggccagcccctgcagtggtgacctcagcggggacagccacctcctgctgggcaccctggctccagcgctcctcctgaccacggacatgtcgtcactcgcttctggtgccaccgacgtgaggaccgaggctgggagcccttcctgttacacgttatcatgaggctgggagccccgcctgcgcttggcctgacagcctttcctgtcacacgttgtcacctatctagtcctaccgacggtttcaaggtattttcctcaaaaaccttaaatgcaaacccacagaacccgcctgcctgtccctgaggggcctggtgcctccgggatccacgcggcgctgtgatcacagcagtttgtggtcctgacactactgtgactaggccactgggagctggggtctttcaaagcactttgtaaaccgaggaatttagttagaggttataaattgctctaagctgctttctgtttttttttaatatgcgataatatgaagctttatatgtgtactgtgaacttaaatatttcatatcagtttattgtcaattcatagtatgctaaatatattagatttcatattctgaaactagtacttatgaaatgag

SEQ ID NO: 2583 - DNA, 1634 bp, Homo sapiens
atgctgccctggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttg

SEQ ID NO: 2584 - DNA, 4974 bp, Homo sapiens
ggtgcgaagccattcacccagcgcattccgccgcccgcaggcttgcggggaaacttccttattattgtgacgccgaaaacggagaaaccccgggtccggcgagaggggctgtgacagtcggagtcccaagctgcggttcggctgctgccgagaactgcaaggtgtggaatatttctggcttctagtccaatgccaagtgtgtgacctgtggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaattggagctctggcagatcagcatatcattcatgtggcatgtggcgagtcccacagtctggccctcagtgaccgaggccagctgttttcttggggtgcagggagtgatggtcagctaggactcatgactactgaggattctgtggcagtgcccaggttaatacaaaagctgaaccagcaaacaatattacaagtttcctgtggcaactggcattgcttggctcttgcggctgatggccagttcttcacctggggaaagaacagccatgggcagcttggcttagggaaggagttcccctcccaagccagcccacagagggtgaggtccctggaggggatcccactggctcaggtggctgccggaggggctcacagctttgccctgtctctctcaggagctgtttttggctgggggatgaataatgccgggcagctagggctcagtgatgaaaaagatcgagaatctccatgccatgtaaaactcttacgcacgcaaaaagttgtctatattagttgtggagaagaacacacagcagttctcacaaagagtggaggtgtgtttacctttggcgctggttcctgtgggcaacttggacacgactccatgaatgatgaggttaaccctagaagagttctagagctgatgggtagtgaagtaactcaaattgcttgtggcagacaacataccctagccttcgtgccttcttctggactcatctatgcatttggttgtggagcaagaggtcaattaggaactgggcacacttgtaatgttaagtgcccatctcctgtcaagggttactgggctgcccacagtggccagctttcagcccgagctgatcgctttaaatatcatatcgttaagcagatcttctctggaggagaccagacttttgtactttgctccaaatacgagaattattctcctgctgttgacttcaggactatgaaccaagcacattataccagtttaataaatgatgaaaccatagcagtttggagacaaaaactctcagaacacaacaatgcaaatacaatcaatggtgttgttcagatattatcttctgcagcctgttggaatggaagttttcttgaaaaaaaaattgatgaacattttaaaacgagtcccaaaatccctgggattgacctgaactcaactagggtgttatttgagaagttaatgaactctcagcactccatgattctagaacagattttgaacagttttgaaagttgtctgattccccagttgtcaagctcaccaccagatgttgaagccatgagaatctatttaatactacctgagtttcccctactccaggattccaagtattatataacattgactattcccttggctatggccattcttcggctggatacaaaccccagcaaagtactagataactggtggtctcaggtatgcccgaaatatttcatgaagctggtaaacctctataaaggtgcagtcctttatctactgaggggaagaaagacattcttaattcccgtactgtttaacaattatatcacagcagctctcaaactcttggagaagttatataaggtaaatcttaaagtgaagcatgtggaatatgatacattttacattcctgagatttccaatctcgtggacattcaggaagactacctcatgtggttcttgcatcaagcagggatgaaggctagaccatcaataatacaggatactgtaacactttgttcctaccctttcatctttgatgcccaagccaagaccaaaatgttacagacagatgctgaactacagatgcaggtggcagtcaatggagccaacctgcagaatgtcttcatgcttctcaccctggagcctctgctggccagaagccccttcctggtccttcacgttcgcaggaacaaccttgttggagatgccctaagagagctgagcattcattctgatattgatttgaaaaagcctctcaaagtaatctttgatggtgaagaagcagtggatgccggtggtgttacaaaggaattttttcttttgctgttaaaagaacttttgaatcccatctatggaatgtttacctactatcaagattcaaatctcttgtggttttcagacacgtgttttgtagagcacaactggtttcacttgattggtataacctgtggactagctatctacaactccactgtggtcgatctccacttcccattggctctctacaagaagttactcaatgtaaagcctggcttggaagacttaaaggagttgtcacccactgaaggaaggagtctccaagagcttttagattaccccggggaggatgtggaggagactttctgcctcaacttcacgatctgccgagaaagctatggagtgattgaacagaagaagctgatacctgggggagataatgtaactgtgtgcaaggataacaggcaggaatttgtggatgcttatgtgaattatgtcttccaaatctcagttcatgaatggtacacagccttctctagtggcttcctaaaggtgtgtggtggcaaagtacttgagctcttccagccttcagaactgagggctatgatggtggggaacagcaactacaactgggaagaactggaagagactgccatctacaagggagattactcggccacacatcccactgtaaaactattttgggaaacatttcatgagtttccattggaaaagaagaagaagtttctcttgttcctgacaggcagcgatcggattcccatctacggcatggccagtctgcagattgtcatccagtccacagccagcggggaggagtacttgccggtggcccacacttgctacaaccttcttgacctccccaagtacagcagcaaagagattctgagtgcccggctgacccaggcccttgacaactatgaagggtttagtttggcctgaggcttctcagcttgtccagtatttcccttcgttcctcagtgtccacattgaggcctatacagaaaatcatggggagtgatttctatttttttattgtctaagtgggttgggacttttaaatactgagcctggttgatgtgtttctgggattgtatagcagtaaacaacctttttgaaaaattagaggttggggatggggtgaaaaattggcccttgtatgggaggtgtttttgtttttgttttaaaccaaactacccagtattccttgcacttgtgaatgtgttgcactctgctggatgaaatggcagtggatttttaaactttaatttcccaaatgtctctctcagccctgatgttttctcacagtgcttccttgtccttctcttaacttctcattcctctataagaatgatttagactgacctgtccttttttatctgcgcatgcgagaacatcaccttcctctgtacacttggaaatgcctctggcttgttgcagccctcctttaacccaaaggaggaaaggactgcttcagaaactcccaattccaaaaagctgagtctgggtccattattttggcagaactcctaagaatttatgggagcctatataaacatatcttgcttttaaaaagttcttgagggaatagcaactttcccatggctgtgcctatttcctagaccttttaaaagatgtgcagagcagcttagcattcgttgcagctgagcctaattttttcttgctcatccttgtccctttgacaataaggttaattgatagacccaccacctcttgcactctcgcttttggagcaagttgcattaactattttgagtctctatattgtccaagaaaagtagaaataataaatttactttccctttttctatcaccttatgtcctctaccattttctccttcctcccttcccttattttctccttttcgtaccctgtgtcctccctgattttcctttcgtttcttctttattttatcccattctctgttacttgactcagtgctcccttcctctcctctccttctagtggatgcatgcagcctttttttcaatttttatttaaattgcaaaatttttactcagattttttttcctcttccctaattgctaagatttaaggacgttctttattatgaaactttatcacattcgaaatgtttgtttacagtgggattttaggggggattgtgtttaaatcaaatatatgtattttaaaaataatgacatgctcaaccttcctcatcatggagtaagaaaattctacatgattaaagaatccatgtaagtctaattttaaattcctagtaactagagaaaagacttatttatataaaatgaagtatttatgaactgtgataaagcatcaaatcttgatgaaggattgtagatttttgctttttctttttgtttttaaaacttattccaattgctaaattggtagtttttcagtctttataaatacaggattaaaaatatatatacagttatatgaaatgtttattttctatgtgtgtgcatatagttcaatattatgcaataaatttggtgttttaacttaaaacta

SEQ ID NO: 2585 - DNA, 567 bp, Homo sapiens
gactcacgccttcgccgtagcatctttcgcagcggaccgaagagaagaaaagtaggccagagccgaactctcttcctgccaagatgtctattggtgtgccgattaaagtactgcatgaggccgagggccacattgtgacatgtgagacgaacaccggtgaggtatatcgggggaagctcattgaagcagaggacaacatgaactgccagatgtccaacatcacagtcacatacagagatggccgagtggcacagctggagcaggtatacatccgtggcagcaaaatccgctttctgattttgcctgacatgctgaagaacgcacccatgttaaagagcatgaaaaataaaaaccaaggctcaggggctggccgaggaaaagctgctattctcaaggcccaaggttatctgagttcattggagtgggtgcttgtgcatatatgctaggtcccagagaaaaacctccatgctgggttgatagcagcagctaggatcagttgcccaagactctggattctcgagatgaagaccgtcagcagaggctgatctctcctgtgggctcatgtcc

SEQ ID NO: 2586 - DNA, 1696 bp, Homo sapiens
agcgtcacgcagcgaggccgtgcgtgcgcgggcgtcagggcggcgctgagttgaggacgctggcggctccgcgacgagctttgttttttcggttgggcatgctgcttaccgcaggatgatggaagcgacggcccgtacaaagacagaagcgttggtttcactgagtcagtgctgattctctcaaatagagcttgaaggataaatcttcatttttgtttcaacaaaacttcgaaacaaaatggaagaaaataatctacagtgcagtagtgtggttgacggtaattttgaagaagttcccagggagacggcaattcagtttaaacctccactatacagacagcggtaccagttcgttaaaaatttagtggatcaacatgagcctaagaaggttgcagacctgggatgtggtgatacttcactcttaaggctgctaaaagtcaatccatgcattgaattgcttgttggagtagatattaatgaggataaattacgatggagaggggattcgttagctcctttcctgggggattttctgaaacctcgggatctgaatttgaccatcacattgtatcatggctccgttgtggagagagactctcgtttgcttggatttgacttgataacgtgtattgaattaatagaacatttggattcaggtgatctggccagatttcctgaagtggtatttgggtacctgtctccatccatgattgtcatcagcacaccaaactctgaattcaatcccctgtttccatcagtgaccttaagagattcagatcataaatttgagtggaccagaatggagtttcagacctgggctttatatgtggcaaatcgctatgattactctgtggagtttactggtgtcggggaaccaccagctggagctgagaatgttggatactgtacccagataggaatcttccggaaaaatggaggaaaggcaacagaatcatgtctttcagagcagcatgatcagcatgtttataaagctgtttttaccacctcatacccaagcttacagcaggaaaggttctttaaacttgtgttggttaatgaggtgtcccaacaagtggaaagcttaagagtgagccacctgccaaggcggaaagaacaggctggggaacggggtgataagcccaaagacattggtggctcaaaggcccctgtcccatgctttggaccagtcttcacagaggttgagaaggccaagatagagaactctcccacacccttctgtgttggagataaatttttcgtacctctgcagagactccttgcgtatcccaagttgaaccgcttatgtgctaatgaagagatgatgagatcagtcattgctgactcaattcctctgagcagtgatggttctgcagtggtggctgacctgcgtaattattttgatgaacagtttgagttttgaaccatgtttatttcctgaaatttcagggtctcagcgatagttgtgctcacttagaatttagttttttttgtgtaatcctaattcaagtaatgtttttaaagtttcactgcaaaagtctatgttccaagccattggacagacctgcttgagatatggccagactgcagtgagccctgagaaagatatgagggtttaaaacgggtgctttcctttgattttggacttttttgttttctcaagaataaagaagttggatgtggtaatatgttaattttg

SEQ ID NO: 2587 - DNA, 622 bp, Homo sapiens
ggcctgtgcggctgcaggtagagtgtcttaggaacctaggaaataactcggaacctgtaacgtcccactggtttggacatattcctctcctgatctggcctcatctgttccagggaggtgggattgaacaaagtcttgctctgtcacccaggctggagtgcagtggcgcaatcacggctctctgcagcctcgacccccggggctcaagctattctcctgcctcaccctcctgagtagataggactacaggcacgtgcggctatgcctagctaattttttaaatcttaagtagagacattgtctcactgtgttgcccagactggtcttgaactcctaggttgaagggatcttccagcctctgcctcccgaagtgctgtattacagaacatatgcagtaatgtcacctcaaaagagagttaagaacgtccaggcacaaaacaggacttcacaaggtagtagtagttttcagaccacgctttcagcctggaaagtaaaacaggatccaagcaactcgaagaacatctcaaaacatggacaaaacaatccagtgggagattatgaacatgctgatgatcaagctgaagaagatgctttgcaaatggcagtgggatattttgagaaa

SEQ ID NO: 2588 - DNA, 2033 bp, Homo sapiens
cgtgtatacccgctcaacgctgggacgttacagccagggccaatgggcagagcgggactcgaggccccgcccccgccttgtggcgtcacggggacgccgggggcgcgcgggctgcagggccgcgtaggtccccgcccccagagtctggctttccgcggctgcccgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggttgctgcagcaactggtcacacagtagtgttggtagaccagacagaggacatcctggcaaaatccaaaaagggaattgaggaaagccttaggaaagtggcaaagaagaagtttgcagaaaaccttaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgagacttccaaacgtgtggtgattctaactcgggtttgggcttttctttaaaaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggcagaagcta

SEQ ID NO: 2589 - DNA, 2210 bp, Homo sapiens
aacgccagcaggcttccgggcccggagtgggcggtgggactcggggtcccagagagccgtgcgcgggccgcgacgccgagcaccgccctcgccgtcgcctccgggctttctccggtcgctgccgccaccaccgttgcttcgcgggctgggaggcccggggtccccgggcgaacagaggctgcggtggactgacgccgcaggggcgagctagccggctccgcgcctctccgcgggatccagacgcctcctggggctgctggcggagggtctgaggcggcgcggccatggctcacctccggggatttgccaaccagcactctcgagtggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcagtcagtgcgacagcccctacatcacccgctactttggctcctacctaaagagcaccaagctatggatcatcatggagtacctgggcggcggctcagcactggacttgcttaaaccaggtcccctggaggagacatacattgccacgatcctgcgggagattctgaagggcctggattatctgcactccgaacgcaagatccaccgagacatcaaagctgccaacgtgctactctcggagcagggtgacgtgaagctggcggactttggggtagcagggcagctcacagacacgcagattaagaggaacacattcgtgggcacccccttctggatggcacctgaggtcatcaagcagtcggcctacgacttcaaggctgacatctggtccctggggatcacagccatcgagctggccaagggggagcctccaaactctgacctccaccccatgcgcgtcctgttcctgattcccaagaacagcccacccacactggagggccagcacagcaagcccttcaaggagttcgtggaggcctgcctcaacaaagacccccgattccggcccacggccaaggagctcctgaagcacaagttcatcacacgctacaccaagaagacctccttcctcacggagctcatcgaccgctataagcgctggaagtcagaggggcatggcgaggagtccagctctgaggactctgacattgatggcgaggcggaggacggggagcagggccccatctggacgttcccccctaccatccggccgagtccacacagcaagcttcacaaggggacggccctgcacagttcacagaagcctgcggagcccgtcaagaggcagccgaggtcccagtgcctgtccacgctggtccggcccgtcttcggagagctcaaagagaagcacaagcagagcggcgggagcgtgggtgcgctggaggagctggagaacgccttcagcctggccgaggagtcctgccccggcatctcagacaagctgatggtgcacctggtggagcgagtgcagaggttttcacacaacagaaaccacctgacatccacccgctgaagcgcactgctgttcagataggggacggaaggtcgtttgtttttgttctgagctccataagaactgtgctgacttggaaggtgccctgtgctatgtcgtgcctgcagggacacgtcggatcccgtgggcctcacatgccaggtcaccaggtcaccgtctccttccacccctgcagtgtgctgttgtgcacgtcagggacgctgttctctatgcccactgccctcctccctctcctggcccagcagtattgctcacgggggctccagccgccggcgtggccctcatgagctacgcctgggtcttctgcagactcatgcagccctatggccgctcagaccaaggcgcagagcaactatcagggcagctctgcctcctcctcccatgaggtggggagaggcaacagggcagcccccagaggagtgtcctggccgctgtcctcccggggcccatgatggccatagatttgccttgtggtgttggatcaggtactgtgtctgctcataagtacttgtgtcatccagaatgttttgttttttaagaaaattgaattacttgtttcctgaaatattctgaggttaatatgttagttttcatagaacattgagaggcccctgccactttcaataaagacctgacttggagaca

SEQ ID NO: 2590 - DNA, 1751 bp, Homo sapiens
accgccgccgccgccgctggccaaaaagcggagcccaggggaagcgtgtcctgctcagaccgccttccttctccattgccacccgtgccgaacagccaggctgcccaattgcaactgtagaccaatgaactaatccatcgcccgcagcccgactctcagcagcggttcgtcccggtgcccacccccgcgaagcggagcgcccgggcacctagcctccctgccggccacctagcctccctgccggccacgatgccgaacgtgctgctgccgcccaaggagagcaacctcttcaaacgcatcttgaaatgttatgaacagaagcagtacaaaaatggcctcaagttttgcaagatgattctgtcgaacccaaaatttgctgaacatggagagactttggctatgaaaggattaacactgaactgtttaggaaaaaaagaagaagcttatgagtttgttcgtaaaggacttcgtaatgatgtcaagagtcatgtctgttggcatgtatatggactcttgcagcgttctgataaaaaatatgatgaagctataaaatgttaccgaaatgccctcaaattagataaagataacctgcaaattttgagggatctctcactgttgcagatccaaatgagagaccttgaaggttaccgagagacaagataccagcttcttcagttgcgccccacacagcgtgcctcctggattggatatgctattgcataccatttgctgaaagattatgatatggccctaaaactgttggaagaatttagacaaactcagcaagttcctccaaacaaaatagattatgaatatagtgaattgatattataccagaatcaagtgatgagagaggcagatctgttgcaggaatctttggaacatatagaaatgtatgagaaacaaatatgtgataaacttttggtggaagaaattaaaggggaaatactgttgaaattgggaagattaaaagaagccagtgaagtgttcaaaaacttgattgatcgaaatgcagaaaattggtgttattatgaaggcttggaaaaagctctacaaattagcactttagaagagaggcttcaaatttatgaagaaattagtaagcagcaccccaaagcaattacacccagaagattacctttgactcttgtcccaggtgaaagatttagagaactaatggataagttcctgagggttaacttcagtaaaggctgcccacccttgtttactactttgaaatctttatattacaatacagaaaaggtttctataatccaggaacttgttactaattatgaagcctctcttaaaacgtgtgacttttttagcccatatgagaatggggagaaggaacccccgacaacactactctgggttcagtatttcctggcacagcactttgataaacttggacagtattctttggctttggattatattaatgctgcaattgctagtactccaactctaatagaattattctatatgaaagcaaaaatttacaaggtaaaatctgaatcctgttttttgagtagttgaagaattcagctactttaagaatccttggagttttttctttgtggaaacaagttctagggcaccctgataatctttttctaataatcctgtgtagtttcatgttatattaattgtataatcaatgtgtaattagatgtgtaatcatttgagctcttagtaaatgtgaactgtaattttgatttctaaataaatttgacagaaatggtgacaga

SEQ ID NO: 2591 - DNA, 555 bp, Homo sapiens
atttactccatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtagacattgcttctgcagaaagcagcatttaaatgctgatgcgtgacatagcttcctcattttatttttctgaagtgatctgctggaattccaaacagaagttccatatatacaaatatgtggcttaaatatttctaaatagaagaactattttcaagtaaaataaaggctgaggttttgtattt

SEQ ID NO: 2592 - DNA, 4121 bp, Homo sapiens
gaatccccggcggcggcgcggggcggccgcggaccgtgagtcagcattggcggcggccccagcgcgtggcagccgtgcgccgccaaggtgcgggtctcgttactcggcggtcaggagcgggccctcccttaggtgcgccccccgccaggttctgcgttagacctgcatcttagcaatgtgaatattgcatccctagagaaggacctggaagagcaagacggccacgacctgggagcagcaggtcccaggtcgctggccggctctgcacctgtcgccatccccggctccctgcccagagcaccatcgctacactcgccatcctctgcgtccacctcgccgctcggttcgctgtcccagcccctcccagggccggtgggctcctcagccatgacgcctccccagcagccgccacccctgcgttcagagccgggcacactgggctctgcagcctcatcctacagccccctaggtttgaacggtgtccccgggagcatctgggactttgtttccggcagcttctcccccagcccctcccccatcctgagtgccggccccccatcctcttcgagtgcaagtccaaacggagctgagctggcccgggtcaggcggcagctggacgaggccaagaggaagatccggcagtgggaggagtcctggcagcaggtgaagcaggtctgcgatgcctggcagcgagaggcgcaggaggccaaggagcgtgcccgtgtggccgatagcgaccggcagctggcgctgcagaagaaggaggaggtggaggcacaggtgaagcagctgcaggaggagctggagggcctgggcgtagcctccacactgccggggctgcggggctgtggggacatcggcaccattcccctgccgaagctgcactcgctgcagagtcagctgcgcctggacctggaggcggtggacggcgtgatcttccagctccgcgccaagcagtgtgtggcctgccgggagcgggcccacggtgctgtcctgcggccctgtcagcaccacatcctctgtgagccgtgtgcggccaccgcacctgagtgcccctactgcaagggccagcccctgcagtggtgacctcagcggggacagccacctcctgctgggcaccctggctccagcgctcctcctgaccacggacatgtcgtcactcgcttctggtgccaccgacgtgaggaccgaggctgggagcccttcctgttacacgttatcatgaggctgggagccccgcctgcgcttggcctgacagcctttcctgtcacacgttgtcacctatctagtcctaccgacggtttcaaggtattttcctcaaaaaccttaaatgcaaacccacagaacccgcctgcctgtccctgaggggcctggtgcctccgggatccacgcggcgctgtgatcacagcagtttgtggtcctgacactactgtgactaggccactgggagctggggtctttcaaagcactttgtaaaccgaggaatttagttagaggttataaattgctctaagctgctttctgtttttttttaatatgcgataatatgaagctttatatgtgtactgtgaacttaaatatttcatatcagtttattgtcaattcatagtatgctaaatatattagatttcatattctgaaactagtacttatgaaatgagtgtttatctagtagtaagacctaggatttttacattttccaattaagtgcaaatagtatttataagcagagtgattatggattgagatgtttttaacttgatggaaggagctagttttcctgagcctgtgtgtgcaccaggcactggggctgatgttccagcctcgtggcgtgggagcaggagagctccgtcctgcatttctgtggtccgtggccgctgtttctgtgcgcctgcgcctcggagagcaagtgaaggagcatcatgggttttgttttctcccttaaccctctgaaagacagtttgatactaacaaaaaacgcagcagaggggatccgacgtcagagcttttagaattacttttttaagcagctgtcttctggctgggtgcggtggctcatgcctgtgatcccagcactttgggaggcgggtggatcacctaaggtcaggagttcaagaccagcctggccaacatggtgcaaccccgtcttagtaaaaatacaaaaattggcctggcgtgagagcgggcacctgtagtcccagctactcgggaggctgaggcaggagaatcgcttgaacctgggaggcagaggttgcagtgagccgagatcgcgccaccgcactccagcccgggtgacagagcgagactctggctcaaaaaaaaaaaaaaaaagctgttttctgattactcagagctgtcctaggcaatggtgctttgtagctccttggagatgtcgctgggcgtcctggcaggggtcaggcagtgaactgggagagtggttgcctccccagcacccgtgaccaccctggtcctgctcgtgtgggagatgctcgggccgtgtgtgcgccagggtccggggtgccgggtgtatgtggcagtcacctgacccgcgctgccagttatcatcggagctcatccatgtggccagtgaggtcacaggagaggacccggccacagcctctcagtggcctggagcacacgggggaagcgaccccccccaggtcccggctctgctgtggtcccctgtcccgtctgcccctggagcgacagtgtggtttcggccgcagcagaaacgtgactgagaacgcatccccgcgatgacctgacccttctgctcagggctgggactgtccctaggagttgagcaggaacaggcatctgtggtttacggcgacctggctctccgcgggccacgtgggtggtgagggcacacgagtgggaagcggcaccgacgtgtttctccccgaccgtggctttgccaaagacttttaatagcattttttaagtgcaaaacgtctaggtaaaaatctttatcatcagtgaccaaattagaatgtatttaatatagtaggtggtttaagaactgttttaacgtaagacaaactgatagcaacattctgttgttttaaaggaagtgggtccgtgacattctgcagctagtccactactccaaggtaactatcgacttggtttcagtgaatctattttgtttttaactacagtgatttattagctcagtatctagaaattacgtatattttgtgctactgtcatcgatgtgtaaactctgtttttatttgtatttatgcacttggttcccatttggagcctctggtcttttctgggataagtggtgtctgccgagacatctcccggttgtcagtggtcaggagcagctgagctctagtctgccagctgctctgctctttctgggaaggaggtggcgcccgcccctcagggtgtctccagggctcagcttccggggtggtagagctggggagccccaggggtggggggacagctgggagatggaggtggcacctgctcccctagatcagtactggctctgaggacaggtgagcagtgggaagaccaaagaatggctggcagcgctgccagggttggaaatgggggcaagatcctggggctgtgtgccctggggcctccctcacctgtcttggtggccatggcctcagggatggctcctaggtggctgaggcacagcagtggctggaaggtgccccgtggaggctgaggtggaggcgcgcccagcagctcccccctgtggccatggcgggcacggggcgtaggagctggctggcggccggctctgcatgttcttgttgcctgtcgtctgtaactctagtgttcgacattcgccgtgatacagtggtgtcacgacgtgtgtaactgtggtcagcagaccttgttccgcgtggacgcctcaagtggattaatttctggaagcctcaatctgtatgtttgagtatttacatgagaatgttatttgaatggaattttcttaacccagaaggtagtatttataatcatttacttgtagcgaactgtttaaagttaacacttgtttaaatttttttacactatagcatttatgcaatggtttacagaattcatggagttatttttatcagtatgggaattaattaaaaccttgaatcttt

SEQ ID NO: 2593 - DNA, 2110 bp, Homo sapiens
ctgtcccactgggcaggtgcctctgacggagaggaggcgtcgtcgggaagtatgtggccgtggctgctctggcatgatcctgaagactggcacgaaggggaatggagccgcacagagaatttcaggcatcagaggggaagcgcaggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagctcgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccgggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagcacccttaatgtcccgagcaaccccgcccagtctgcgcagtcacagtccagctacaaccccttcgaggatgaggacgacacgggcagcaccgtcagtgagaaggacgacactaaggccaaaaatgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaa

SEQ ID NO: 2594 - DNA, 3581 bp, Homo sapiens
agaatgtcatcctcaagggaagtgcagagagatttcttcagtcctcagctgagtataagctggcctcctggagtctgtgaacacaaacgtccaatgtgagtgtgcctgtgcaagcccctggctgtttatactccggagggtgtccccgtgcgtcatcggtggagtggaccaaaactggtgatctgtttgccctgtgtgaccttgcccagaaccctgctgactgagagaacacatctgctggaagtcctctgggattcaaggtacagggagaactcgaggcctcactgaaacggaaagcaaatacaaagaaactttattttaaaaacatgtcttggtctcccaagaagagggcaattggattgctcagccagaatgaagagtagttttacagaaaaaagaggacaatattgggatcacctttgacctttccatttggaaataatattttctattgtgttatagaaaggtgggaagctttcatccagaacaatgaatttcataaaggacaatagccgagcccttattcaaagaatgggaatgactgttataaagcaaatcacagatgacctatttgtatggaatgttctgaatcgcgaagaagtaaacatcatttgctgcgagaaggtggagcaggatgctgctagagggatcattcacatgattttgaaaaagggttcagagtcctgtaacctctttcttaaatcccttaaggagtggaactatcctctatttcaggacttgaatggacaaagtctttttcatcagacatcagaaggagacttggacgatttggctcaggatttaaaggacttgtaccataccccatcttttctgaacttttatccccttggtgaagatattgacattatttttaacttgaaaagcaccttcacagaacctgtcctgtggaggaaggaccaacaccatcaccgcgtggagcagctgaccctgaatggcctcctgcaggctcttcagagcccctgcatcattgaaggggaatctggcaaaggcaagtccactctgctgcagcgaattgccatgctctggggctccggaaagtgcaaggctctgaccaagttcaaattcgtcttcttcctccgtctcagcagggcccagggtggactttttgaaaccctctgtgatcaactcctggatatacctggcacaatcaggaagcagacattcatggccatgctgctgaagctgcggcagagggttcttttccttcttgatggctacaatgaattcaagccccagaactgcccagaaatcgaagccctgataaaggaaaaccaccgcttcaagaacatggtcatcgtcaccactaccactgagtgcctgaggcacatacggcagtttggtgccctgactgctgaggtgggggatatgacagaagacagcgcccaggctctcatccgagaagtgctgatcaaggagcttgctgaaggcttgttgctccaaattcagaaatccaggtgcttgaggaatctcatgaagacccctctctttgtggtcatcacttgtgcaatccagatgggtgaaagtgagttccactctcacacacaaacaacgctgttccataccttctatgatctgttgatacagaaaaacaaacacaaacataaaggtgtggctgcaagtgacttcattcggagcctggaccactgtggagacctagctctggagggtgtgttctcccacaagtttgatttcgaactgcaggatgtgtccagcgtgaatgaggatgtcctgctgacaactgggctcctctgtaaatatacagctcaaaggttcaagccaaagtataaattctttcacaagtcattccaggagtacacagcaggacgaagactcagcagtttattgacgtctcatgagccagaggaggtgaccaaggggaatggttacttgcagaaaatggtttccatttcggacattacatccacttatagcagcctgctccggtacacctgtgggtcatctgtggaagccaccagggctgttatgaagcacctcgcagcagtgtatcaacacggctgccttctcggactttccatcgccaagaggcctctctggagacaggaatctttgcaaagtgtgaaaaacaccactgagcaagaaattctgaaagccataaacatcaattcctttgtagagtgtggcatccatttatatcaagagagtacatccaaatcagccctgagccaagaatttgaagctttctttcaaggtaaaagcttatatatcaactcagggaacatccccgattacttatttgacttctttgaacatttgcccaattgtgcaagtgccctggacttcattaaactggacttttatgggggagctatggcttcatgggaaaaggctgcagaagacacaggtggaatccacatggaagaggccccagaaacctacattcccagcagggctgtatctttgttcttcaactggaagcaggaattcaggactctggaggtcacactccgggatttcagcaagttgaataagcaagatatcagatatctggggaaaatattcagctctgccacaagcctcaggctgcaaataaagagatgtgctggtgtggctggaagcctcagtttggtcctcagcacctgtaagaacatttattctctcatggtggaagccagtcccctcaccatagaagatgagaggcacatcacatctgtaacaaacctgaaaaccttgagtattcatgacctacagaatcaacggctgccgggtggtctgactgacagcttgggtaacttgaagaaccttacaaagctcataatggataacataaagatgaatgaagaagatgctataaaactagctgaaggcctgaaaaacctgaagaagatgtgtttatttcatttgacccacttgtctgacattggagagggaatggattacatagtcaagtctctgtcaagtgaaccctgtgaccttgaagaaattcaattagtctcctgctgcttgtctgcaaatgcagtgaaaatcctagctcagaatcttcacaatttggtcaaactgagcattcttgatttatcagaaaattacctggaaaaagatggaaatgaagctcttcatgaactgatcgacaggatgaacgtgctagaacagctcaccgcactgatgctgccctggggctgtgacgtgcaaggcagcctgagcagcctgttgaaacatttggaggaggtcccacaactcgtcaagcttgggttgaaaaactggagactcacagatacagagattagaattttaggtgcattttttggaaagaaccctctgaaaaacttccagcagttgaatttggcgggaaatcgtgtgagcagtgatggatggcttgccttcatgggtgtatttgagaatcttaagcaattagtgttttttgactttagtactaaagaatttctacctgatccagcattagtcagaaaacttagccaagtgttatccaagttaacttttctgcaagaagctaggcttgttgggtggcaatttgatgatgatgatctcagtgttattacaggtgcttttaaactagtaactgcttaaataaagtgtactcgaag

SEQ ID NO: 2595 - DNA, 2116 bp, Homo sapiens
gcgcgcccgccgcccgggcggaggagaggagcgcgcggccgcgcagagcaagctgagccgagccgagccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaaggaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaa

SEQ ID NO: 2596 - DNA, 793 bp, Homo sapiens
ggaacgggaacgaccacagccaccgcagggaaacaaccggggcccaggcccagcagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaaga

SEQ ID NO: 2597 - DNA, 1141 bp, Homo sapiens
ggagttggcgcctagcgcgcagctccatccccgcctctgcagtggactcggccgcagaatcggggtcccgggctcctggaacttgtcccgcccaggccgcggcgaggaggtcactccagccgatctctggaccggattcgtcccattctcgtcctcatggtggacaagaaactggtggtggttttcggaggcacaggtgcccagggtggctccgtggcccgcacactcctggaagatgggacattcaaggttcgagtggtgacccgaaaccctaggaagaaggcagcaaaggagctgaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctccc

SEQ ID NO: 2598 - DNA, 2654 bp, Homo sapiens
gcggcggctgctttggcggcggttggtggccgtgcgggcggggagggagggggaggagagaagaggaggtggagaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaacaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 2599 - DNA, 1693 bp, Homo sapiens
cgcgagcgccaggcgtccggccgccgtggctatgttcgtgtccgatttccgcaaagagttctacgaggtggtccagagccagagggtccttctcttcgtggcctcggacgtggatgctctgtgtgcgtgcaagatccttcaggccttgttccagtgtgaccacgtgcaatatacgctggttccagtttctgggtggcaagaacttgaaactgcatttcttgagcataaagaacagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggagatagtggagcaaaccatgcggaggaggcagcggcgagagtgggaggcccggagaagagacatcctctttgactacgagcagtatgaatatcatgggacatcgtcagccatggtgatgtttgagctggcttggatgctgtccaaggacctgaatgacatgctgtggtgggccatcgttggactaacagaccagtgggtgcaagacaagatcactcaaatgaaatacgtgactgatgttggtgtcctgcagcgccacgtttcccgccacaaccaccggaacgaggatgaggagaacacactctccgtggactgcacacggatctcctttgagtatgacctccgcctggtgctctaccagcactggtccctccatgacagcctgtgcaacaccagctataccgcagccaggttcaagctgtggtctgtgcatggacagaagcggctccaggagttccttgcagacatgggtcttcccctgaagcaggtgaagcagaagttccaggccatggacatctccttgaaggagaatttgcgggaaatgattgaagagtctgcaaataaatttgggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggagtaacctggacaagctgtaccatggcctggaactcgccaagaagcagctgcgagccacccagcagaccattgccagctgcctttgcaccaacctcgtcatctcccaggggcctttcctgtactgctctctcatggagggcactccagatgtcatgctgttctctaggccggcatccctaagcctgctcagcaaacacctgctcaagtcctttgtgtgttcgacaaagaaccggcgctgcaaactgctgcccctggtgatggctgcccccctgagcatggagcatggcacagtgaccgtggtgggcatccccccagagaccgacagctcggacaggaagaacttttttgggagggcgtttgagaaggcagcggaaagcaccagctcccggatgctgcacaaccattttgacctctcagtaattgagctgaaagctgaggatcggagcaagtttctggacgcacttatttccctcctgtcctaggaatttgattcttccagaatgaccttcttatttatgtaactggctttcatttagattgtaagttatggacatgatttgagatgtagaagccatttttta

SEQ ID NO: 2600 - DNA, 1306 bp, Homo sapiens
gtctctcggctgcagccctggtgcgacccggcccgttgccgtagagatgggcagggctggatggagtggggtgcggtgagctgagctgaccctgcttcgccacggggactgcagtgaccccggcttgccggcagggcgggtaacaggttgagccagggtggggctgctcaggggcgtggagccgaggccaggatttctctgaagacccggcacaggctattcctttctgcgacgagcccattgctatggaaaccaaagcgttaggccagcggggattgaggctgcgggatcatgacgggtctctctcccgaagaaccttgcctaaggcttccccaagcggctacttcctgagcgaacccgcccacccgcctgaaggagagagttttccatggacacagcctagcagaaagacgcagccttcgtgcttcgctgactgctgaccactgacccaccgccttgatgacagcaccctcgtgtgccttcccagttcagttccggcagccctcagtcagcggcctctcgcagataaccaaaagcctgtatatcagcaatggtgtggccgccaacaacaagctcatgctgtctagcaaccagatcaccatggtcatcaatgtctcagtggaggtagtgaacaccttgtatgaggatatccagtacatgcaggtacctgtggctgactcccctaactcacgtctctgtgacttctttgaccctattgctgaccatatccacagcgtggagatgaagcagggccgtactttgctgcactgtgctgctggtgtgagccgctcagctgccctgtgcctcgcctacctcatgaagtaccacgccatgtccctgctggacgcccacacgtggaccaagtcatgccggcccatcatccgacccaacagcggcttttgggagcagctcatccactatgagttccaattgtttggcaagaacactgtgcacatggtcagttccccagtgggaatgatccctgacatctatgagaaggaagtccgtttgatgattccactgtgagccatcccacgagcccctgcattggagtcagagcccctgcccttgatggatcagctggcaccacccagattgataaactggctcgtctgatcttgtggcccccacccaggaactgactgggcactagaaaacagcttcaacatcctgtgatttcatccctgaccaatcagcactcctgtctcactggcttcccccaacccaccaagttgtccttaaaactctgctccctgaatggtcggggagactgatttcagtaatagtaaaactctggtctcctgca

SEQ ID NO: 2601 - DNA, 2878 bp, Homo sapiens
gcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagctgcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagtgttctctcgacactgccagccccgtgttagcacctgggcctcagtcccacttgctcccaggcgccggttctgtggttggtttggaattaaagtcctgtttgaagttgtcagacacagacatgaatttctgggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtgggcggcctgggcagaagggcggctggctgtcctggagctgctgctggagcctgccctcagagtgtccctttccagtgctgtggcattctgtggcagcttccccaggtgtggtgacggggggggggcggggcctccacctgtgacagccaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccagagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaa

SEQ ID NO: 2602 - DNA, 1557 bp, Homo sapiens
gaccagaaaagccagactaatcaggacgagttcgggcgtggaattgggcctgaagccctcatgcccagccaggcctgaatgccccagaccccaccgtcacccccgtggcctggatggagcaggggacggccggcgaaggcgcggggtggaaggggagcggcgacgaaggcgcgaggagctgactgggaatccccaagctacccgaggcaagacactgaacttgagtcgcacttttcatgcctgtagaaatgagaatgacagctgtgataaaaaaaaaattcatctgggcggtatctggaacttggcggtggatgaggagggctgctcgctggctgcggctgaggctcggtcaccgtgtagagaggcccagggagagctgcttcactcaagtcctgtcaagtcaaggcagccgggatttgtccacatctaaggcgaaagagaatgaaagacgtagataacctcaaaagtataaaagaagaatgggtttgtgaaacaggatctgataatcaacctcttggtaataatcaacaatcaaattgtgaatattttgttgatagcctttttgaggaagctcagaaggttagttccaaatgtgtgtctcccgctgaacagaagaaacaggtagatgtaaatataaaattatggaaaaacggattcaccgtcaacgacgatttcagaagttattccgatggtgccagtcagcagtttttgaactccatcaaaaagggggaattaccttcagaattacagggaatttttgataaagaagaggtggacgttaaagttgaagacaagaaaaatgaaatatgtttgtctacgaagcctgtgttccagcccttttcaggacagggtcacagactaggaagtgccacaccaaaaattgtttctaaagcaaagaatattgaagttgaaaataaaaataatttgtctgctgttccactgaacaacttggaacccattactaatatacagatctggttggccaatggaaaaaggattgtccagaaatttaacattactcatagagtaagccatatcaaagacttcattgaaaaataccaaggatctcaaagaagtcctccgttttccctggcaacagctcttcctgtcctcaggttgctagatgagacactcacactggaagaagcagatttacagaatgctgtcatcattcagagactccaaaaaactgcatcttttagagaactttcagagcactgatttttgatagactaagtggaaaatttgcagagaaatgatggttgtaagtggacatgcaaaccaaaattggggattggagaagtcagactcactagacttttggttcgagtactattgaactctctcctgatgagaagatgtttagataagtacaagttaagaaagtagcatatgactggaaactatattcagtgcactttctccaaaagactacccagaaaaatagacttattttcaaataccagttatcaagatatattaaatagctgtattgtttagaatcttaatatggtataaattagcatatgtattcacaatattcattcagacatcatt

SEQ ID NO: 2603 - DNA, 2958 bp, Homo sapiens
gggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccaggtgagcccccatcctggcccatctctgcaacagccagaggctgactgggactgtactgctttagtccaatctagcgttcgcagcgtcaggcccctccagagcttgtcgtcgtggtaaccccgactgtaggtacacaggacagaaagcaagtgtctacccacccagtgaagccccccaagagcaagactcttccttccagctagcagagcctggggttacacagcttctttggagtaggggagtaacacaggtgctcagcgaatcccgcctgaggcagagcccctgcctaggcctcctccctcacacacacgtcgccctgtcagaaggccaggcacactactgcagccaggatgctgggatagcaaggggataggtgctccaaccttcaccttccagaaaggcagggtgatctgaagtgacgtgtagctgagagctggatggggagaatttcactttcccagttgatccagaaaggaaagaaaccccagagcatcctctcggaagaacttaaactggctttgggctccagtgcgagcgagtgacttgtggaaaggggcaccatgatgagaggccggggccggtgggtgttgctgtcctgggtgaacatctcgtcatctgtctgttctttctccccggcatcatatcccttatagtctgtgctccaggtaaacagtgtctctgccagccacagcttggcaagcccggctatgtctggccactgagagatgctgcccgcagctcgatgatgtgctgggatgttctggggtggggctgctgagattgcactgaaaaagaaagctggagaagccggggctgctcccacccaggctggccccctgtccagctgctgctgtgggcacatgccctagttgtggcctgtggcacctgcttatgacaacaagctttgggtagagcttacttacacccttggtttctccagtccctgcctgctcatgcccctcagagagtgaggtgtctgttccacaagagcacccgctcccctgcaggcctttgtttagggtttggagaaacaggcagagcaggggctgccctcagggagtagagcattagggagctggtgcctggggccttctccctccagtgtggaaatcctgcccaccagccaaaacctgctgcaaatggggactgccagcccagcctgtgggcgcagctgcctgcacagtggatggagcagctctgtgccttctgtgtggtggggagtggctgtctctatgaggctgctaggatgcttgggccccagccagtctgtgcttgcttcctcttctgcctggctccctgacaggtcccccagaagccccagagccctatttgcactgccttaagagtgcccgctggccatgcagctacctggcctttcaggcaggagggatctgatctcaggtggctcacagtggaccacatccatccttgggccagagacactagaggaaaactccagctgtggggtttcagagttgtcaggaactggtgggctcaggaccgatgtcaggctctagggagtcaggctctggggatgtcggttcccacttctgaggagagggacagggaggcctcccaggtggtgaagcaccgacctcagcatccctggaggcaattgggagcctgacgggtttggcggctgctagatccacatcggcgacccacatcctgccggcgtgcacctgcgtctgtgtctgctcctggtgggttgtggggcaggaatcagattcactcattagtaagccgcactcgctgaaggggagagcatgagcaagggagacgtgagccaggccttggttattaggagctaattatgggccaagtatggtggctcacgcctgtaatcctagcacttcgggaggccgaggcgggcggatcacctgaggtcaggagttcgagaccagcctggccaacatggtgaaaccctgtctctactaaaaatagaaaaaaaattagttgggtgtggtgacgcacgcctataatcccagctacctgggaggctgaggcaggagaatcacttgaacccaggaggcagaggttgcagtgagccgaggtcgtgccaccgtactccagcctgggcgacagagtgagactgtctc

SEQ ID NO: 2604 - DNA, 2183 bp, Homo sapiens
ggggagactccaaacagtgagcctagagctggagactagcgttaaccggcggggcggccggttttatgaatgaagctatggctacagattccccaagaagacccagtcgttgtactggtggagttgtggttcgcccccaggctgtcacagagcagtcctacatggaaagtgttgtgacttttctgcaggatgttgtgccacaggcttacagtggaacacctctaacagaagaaaaggagaaaatagtctgggtcagatttgaaaatgcagatttaaatgatacatcaagaaatctggaatttcatgaaatacatagtactgggaatgaaccgcctttgttgattatgattggctacagtgatggaatgcaggtctggagcatccctatcagtggtgaagcacaagagctcttctctgttcgacatggcccaattcgagcggctagaatcttgcctgctccacagtttggtgctcaaaaatgtgataactttgctgaaaaaagacccctccttggtgtttgtaagagcattggatcttctggcacaagcccaccgtactgttgtgtggatctgtattcacttcgtactggggagatggtcaagtccattcaatttaagacacctatttatgatctccattgcaataaacggatccttgtcgtagtcttgcaggagaaaattgctgcctttgatagctgtactttcacgaagaaattctttgttacaagctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccgggccttatctctttggagcggggtgtttttccataaaagccccatggagctacataatgacaaaatatatattttacataaaacctcctaacaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggc

SEQ ID NO: 2605 - DNA, 2333 bp, Homo sapiens
agtccactgctgggcctggaacacggagcagtggctgccctgcgaggaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccaggcgctgccttgcccacagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggcctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggtggtcacagtggacgtgagaactaagaaggtcgtgttcaaggatggcttcaagctggagtacagcaagctgctgctggcaccagggagcagccccaagactctgagctgcaaaggcaaagaagtggagaacgtgttcactatccggacgccagaggatgccaatcgcgtggtgaggctggcccgaggccgcaacgtggtcgtcgtgggagccggcttcctggggatggaggtggccgcttacctgacggagaaggcccactctgtgtctgtggtggagctggaggagacgcccttcaggaggttcctgggggagcgcgtgggtcgagccctcatgaagatgtttgagaacaaccgggtgaagttctacatgcagacggaggtgtctgagctgcggggccaggagggaaagctgaaggaggttgtgctgaagagcagcaaggtcgtgcgggctgacgtctgcgtggtgggcattggtgcagtgcccgccacaggcttcctgaggcaaagcggcatcggtttggattcccgaggcttcatccctgtcaacaagatgatgcagaccaatgtcccaggcgtgtttgcagctggcgatgctgtcaccttcccccttgcctggaggaacaaccgcaaagtgaacattccacattggcagatggctcatgctcaggggcgcgtggcagcccagaacatgttggcgcaggaggcggagatgagcactgtgccctacctctggaccgccatgtttggcaagagcctgcgctacgcgggctacggagaaggcttcgacgacgtcatcatccagggggatctggaggagctgaagtttgtggctttttacactaaaggcgacgaggtgatcgccgtggccagcatgaactacgatcccattgtgtccaaggtcgctgaggtgctggcctcaggccgtgccatccggaagcgggaggtggagactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacacgttaaacattaccgtaaaattaaaacgcacaaatttgcagatc

SEQ ID NO: 2606 - DNA, 2040 bp, Homo sapiens
agtgccaagatgtcgacggcggcggttccggagctgaagcagatcagccgggtggaggcgatgcgcctagggccgggctggagccactcgtgccacgccatgctgtacgccgccaaccctgggcagctcttcggccgcatccccatgcgcttctcggtgctgatgcagatgcgtttcgacgggctgctgggcttccccgggggcttcgtggaccggcgcttctggtcgctggaggacggcctgaaccgggtgctgggcctgggcctgggctgcctgcgcctcaccgaggccgactacctgagctcgcacctgaccgagggcccacaccgcgtcgtggcgcacctgtacgcgcggcagctgacgctggagcagctgcacgccgtggagatcagcgcggtgcactcgcgcgaccacggcctggaggtggggccgccgcccgggccccgccccccgccccggggtttggctctggccccgtggaaggcaccgatgggtaacacgtctcctgagggtcccctggccgggctgggtcgggtgtcgctgtctccagcaatggggtggggagaggggtctggggctgggaggccgggaaaggaggggcgggggtgggggccggcgctggggctccctcagggctgtgttacatccgccttgctgcctgccattgccaatcctgggagtgggggagtgggatcggtggggaggaagggatgggggaggagcggggattgcttggggagttgggaaacttgagcacagcgggggttgtaaaacttgggaacctcatgttgggcgtgaaggctcttgggatttgtactttgtggtctggaagggctggactgcgggtgttcaggcttcgttgggtggacggggggagcatggggtgcggaccccggggtggggtggcctgggtacgaggggggggagtgcatggggtcagcctccacacttgcttggggaggagggggctgcactgctccgagggagctggctggcttctgccaggccctgcgtgggtctcccattaagtccttggcaaagctggctgctcataccctggcctcatagcttccaggcccctcctgctggaggtgccattgtgtggcaggcctggccccaacccctacctcctgtctgcgcaggtgctgggcctcgtgcgggtcccgctgtacacccagaaggaccgagtcggaggcttccccaacttcctgagcaacgccttcgtgagcacggctaagtgccagctcctctttgccctcaaggtgctcaacatgatgcccgaggagaagctggttgaggccctggctgcagccaccgagaagcagaagaaggccctggagaagttgctcccggcctcctcttgagggctgcctgagctggtggcaccctcccctgggccggaagactgggaattcctgctaagtgtggcttctagagtgtttgtgtgtaccccgcttctgactgcctagggcgagtgggcatcctgtcatcatctccactgtcccaagcagtcactaggtggcggccgggccagctggaacccagcccatcctctcaggcagagcagggtggtccgggcacactgggcctgcctctccagcctcaggatgctcttgtttattctgggctcagaccctcctcttgtacgtctcatcacagctggtagagacccaggagtgcctgattgtcccacaggggtggcgcacagctctgggaccactcagaagatgggatgtgtgggtggaggatgccttgtctcggtcagctcattcctgcctccttcctgagccagttcagggcctgggggagagccagcttggggtaggaagttaataatactgttaatttgggttgttgttggatttactttgctagattttctctttcaccacgtgtgaactgtgggtgaggtttcaaagtagcttcaccccacgtggcttggttcccagggacagtcagggcctcgggggcccagctatgtacaacgaagctgtcgaaggagaagacaataaagtcgctccgcagctgctctgtgtgttt

SEQ ID NO: 2607 - DNA, 2013 bp, Homo sapiens
ctttggcctgccatctcccaagggcaaacctcacaactcaggcccaagtcacaggaatctgaatggtggggtgaccttctcctctagtttaatttcattgcaatactgagaaacttcaactgttttgtctttagaagggaaattcatgtttgtgccaggccagcctttgtaaaagcctttgattggattcactagaagtctgtcttcccgcagtacatatactgtgaattttctccttcggcatttcaaccacttggaatggccactaaagtggcttttgatctaaagtaaactctgattctgtgttgatggggaaccatttctctctaacatggtggtttctttaagatgtttgacttgggccacatgagaataacagatctttgggcagtccaagcaagagcctcctgatctagcagccaagactccccctgacctttggccatgtaccccaaccctctcatctactgcacctgctgggacccctggaacttgggaccacggaagctaatcaagacccctcaactaccacgcaagaactccacagggagttccaagctaactcctcttgtaccagctccaaaaaatcacaattacctccaaccaacaaaacctgttgtttccccaaaaatgaaaatccattcagcaaggcaagaagagactaataaatcattttatgaagtgatcaacgtgtcacctggctatcaacttgttcggaatcgggaacagatttctgtcaccttaggggatgagatgtttgataggaaaaagcggtgggaatcggagatcccggacaaaggcagattttccaggaccaacatcatttctgacctagaagagcaaatctcagagctgacagcaataattgaacaaatgaacagagaccaccagtctgcccagaaattgctctccagtgaaatggatctccgctgtgctgagatgaaacagaactttgaaaacaagaacagggagctcaaagaggcccatgaagcagaactcagtgagttggagaacaactacaaagcagccttgaaggcagagaagttggctgcccaagagaagctagaggagatgggaaaagaatacaagtatttgaagaatatgtttcgtacgtatcaggacagtatttatgatgaaatggaagagaagtggtcaaaacagaaggcgaaatggaagaaggatgagaagttcgagcgagaaaatatcctgctacagcaaaaaaaaaagatgaccaaaaaattcgaaatggagtcaggagaagaagataagaaaataaatgaatcctgcagtgctgtctttgagaacttcattcaagagaaggaggagctcttgaaacaacatcaaagtgacaccttgcaattagaagagctgagaaaaaccaaagaggtgccctggagaagagaccaaataaatagacattggcatgatgtcctgcaacagcttcttcttatgcaggtcatgcaggaagaattgcatgcacaagcccttatcctagagtcactgaacacaaacctctactatacccagttggaactccagaaagagaaagctatagtgggaaatctggagaaaatgcttcaaaccaagtttgctgaaactgaagaaaagtataagcacaccatacagatcctgacggaagagaacattcatctgaagcaaaagataatttctaagaatgaagaaatttgtgaaggatgttctgggagattggcctctattactgtttctaaggatgattctgacactgtgcaagatggtagcaagaaaggacaagaatcataaacaaaaagttgctctgcattgttgaagatggttggcacaccatttctgtaggcccaggaaactcctgggagggttttcttgagaaaatgcatataatgagtttagttcttgggttgctctgactctctgaatgtctgaaaatgtttgaattcgcatctgaatttcacagcttatcacggactcttcactgaaaaatgatgctctccatactgggagctgagctttctctga

SEQ ID NO: 2608 - DNA, 3346 bp, Homo sapiens
cgccgccgcgggctcaagcggggcggccgggccagcgcggggcggcggcgggcaggggcggcgagtgcgcgggcgctcgccgccgcccttctcggcgggcagcgcgcgaggaccaggccgaggaggaagtggcggcggcggcggcgggactgcgcgccccagctccgatccccgttccgcgtccccgccgccgggaggaggtgcccactcgctcgcggcgcgcgccggccgccagactcggcctgtgggcgatttcctccggacccaggctccccgcccgaggaggaagatgcagacctttctgaaagggaagagagttggctactggctgagcgagaagaaaatcaagaagctgaatttccaggccttcgccgagctgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattctctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcatgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggggtctgggctgtgctccctcactaaagggaaggaaaggaagctgggcgtcctctgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcattccaggtctttgggcctccacccccttgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctctgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtccttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgcatttcacacgtgtttacacatgttgctcaagtttgttatgtcatactcccagtccttaaaagacgtttaataaaacagctttaccttttaaaaataaaatttcaatcccagtctgcctcaggtacgggtgggggtgtgc

SEQ ID NO: 2609 - DNA, 1484 bp, Homo sapiens
actctggcccggttctcggtggtgcgggagcgggcgggagcagcggccgctctggtcggcggacgtgctgccgagtagtcccggaagcgaagcagcgatggcggagagtccgactgaggaggcggcaacggcgggcgccggggcggcgggccccggggcgagcagcgttgctggtgttgttggcgttagcggcagcggcggcgggttcgggccgcctttcctgccggatgtgtgggcggcggcggcggcagcgggccgcgctgcttagccactgggaccccacgctcagctccgactgggacggcgagcgcaccgcgccgcagtgtctactccggatcaagcgggatatcatgtccatttataaggagcctcctccaggaatgttcgttgtacctgatactgttgacatgactaagattcatgcattgatcacaggcccatttgacactccttatgaagggggtttcttcctgttcgtgtttcggtgtccgcccgactatcccatccacccacctcgggtcaaactgatgacaacgggcaataacacagtgaggtttaaccccaacttctaccgcaatgggaaagtctgcttgagtattctaggtacatggactggacctgcctggagcccagcccagagcatctcctcagtgctcatctctatccagtccctgatgactgagaacccctatcacaatgagcccggctttgaacaggagagacatccaggagacagcaaaaactataatgaatgtatccggcacgagaccatcagagttgcagtctgtgacatgatggaaggaaagtgtccctgtcctgaacccctacgaggggtgatggagaagtcctttctggagtattacgacttctacgaggtggcctgcaaagatcgcctgcaccttcaaggccaaactatgcaggacccttttggagagaagcggggccactttgactaccagtccctcttgatgcgcctgggactgatacgtcagaaagtgctggagaggctccataatgagaatgcagaaatggactctgatagcagttcatctgggacagagacagaccttcatgggagcctgagggtttagaccctgctcccatctccccttcccccactcaagagtcccagcagaatcccttccccccaccccagggatggagaggcactgtgtatctccctccagactcgaagtcatcctgcaagatggcaagaaccaagcaagctccgatcccagggtgtgggagtgggggcctgttcccggtctgacctccttggcactggagcatctggggcttcgttcatccattcatcccgtatcaggggccaaggtacctttacaggagcacctagagcgagggcctttggcaaaaacaaaacaaccaacacacctctccacagggccagctccttagggataagtggaagatggaaattgcaattccaagagggagtgtgcccaaatgatttatggggatacctg

SEQ ID NO: 2610 - DNA, 975 bp, Homo sapiens
ccgccttgcagtttgatctcagactgctgtgctggcaatcagcgagactccgtgggcgtaggaccctccgagccaggctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctctt

SEQ ID NO: 2611 - DNA, 4421 bp, Homo sapiens
gctgccacccattggctcaggccgataccacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcagtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcagtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaatgtg

SEQ ID NO: 2612 - DNA, 1938 bp, Homo sapiens
gggttccggtgttcgcggaggagtcgaggcacggagaggcttcgggggagggacggaaagaagggtggcccgccaggcgggcggggtccatggattcggggtgagggccgtccgcggcctcgctttcgcctcctccgagccgggccggcgatggccgcagctgtgaggcgaggtcgggtcccgtagcggcgcgcagcctccttgggggactcggggtcctgtatattttgaatacatctgtcttcataaaatacaccatgtccaaaatctaaaagggccaattccaaattattccaccagctttgaagggaattgaagcaagaataacaagacagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaagttcacagaaatcagccaccgcatcctgtgctcatacaacaccaacattgaagagctctttgcagaaatcgatcagtgcttggccataaatcgaagtgttcttcagcagttggaagaaaaatgtggccatgagatcacagaagaggaatgggagaaaatccaagtgcaggctctgcgccgggagacccacgagtgctccatctgcctggcccctctctccgctgctggcggtcagcgcgtgggtgcaggcaggcgttccagagagatggccctcctgtcctgctcacatgtgttccaccatgcgtgtctgctggcactagaggagttctccgtgggagacaggcctcctttccatgcctgtcctctctgccgctcctgctaccagaagaagattcttgaatgttgaattcatagtcaaggaaagttaggtaattctgaggaaaaaagtttaccatcattttggatgaactgcatgagttctgggttaagtactacaatgtaatctgtttcccagggaaataagctattggtagttgtaggaaatcttagtatattttaaaagctgacatcccacctaattttaatctttggtctctaaaaagtaaatttcaaatttatgagtttaatcacttcaaatatgaatagcaaaaaatgagagcttgcttacttctaaaaattgaggttaagatatagctagtgtctgaacgacactccttaaagtaagttccaaatgtaaaacactccttaagttccaaatgttttccgctaatagtctgtcctaaagcctttgccattcctaatactcgttttgtaataattgctgtatttctgtgtaataaaatataa

SEQ ID NO: 2613 - DNA, 3966 bp, Homo sapiens
gcggccggtgggctccgcccttaaccaagatggcgatacgcgtgggaccggaaagagtttatagatttcccgtctaccctacctctgaggtgaaggtgggactgccctgtggagcccaccctttccgttatgcgcccgcgcggcgcaatgacgtaacacaggcccgcccactgcccctgttgggttcctgagtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaagtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaaggtctggaccataacttctgtcagggcagagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatgtg

SEQ ID NO: 2614 - DNA, 1059 bp, Homo sapiens
atattccttatgccccccggctggagctgcagcgccagcctcccgccctaccgccgtttccgtgggctgagccgccctgcggccacccggtcccgcgccagtcagtgcgccgccttcccgggggacacctcactcgccccttgctgcgccgtcggctccccagcgcttccactcgacctcgcaccccactcgcctgctgggctcgagcgggggtgtgcggcgattatccgtgcaggcggtgcggggagtgggtctgggagagcggccctttgcgcgtgttcctcaggccctttctgccctggtttcccagccagtggacaggaagcttcattcaagcaaagctgggtgcaaacatgagtgtcgttcttggtagagggcggttggaagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttga

SEQ ID NO: 2615 - DNA, 3531 bp, Homo sapiens
agatgctgaggaatatggcaagaagttggggttcaaagtctgatgccaaagctagcaacccgagaaataaaaccgctgatcaccagctccccactcaggcccagcccccttttagagcccccagactccccacgcagggccctagccccctagtcttccccgtcaatgccctgttggcaatacagccatcaggttctatcagagtgagctgtttttatatgattattttcccccctgggaagacggctttgtctgtgaaagtccccccaaccaggcgccttataaacgcctaaaacagacagagttgaggagaaaggaggggaaaggaggagggagcaaacccggaggggggccctgaggttcgcagcgggcaggatgggggtatgaggccggagtcggcggctcccaggcccccagccccgtcagggcgcccccgtccccaggcgccagagccggggtccgcagccccctagcactccctggacggccgcgggcctcccacaggcctcgaagtccagagactgatcctgcgaccggaaacgcccccctgcccagggggccctgccagcgacgcccctgccagcccccgagaccccctgcgcggggtcggcaaagcatctggacaccccagaagctccggacgccgaagagagaggccccacgaaaatttcaagacacctcctgggggctgcaggggcggccaagtctccccagcgccaggtgcccccggccacacgtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctgctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 2616 - DNA, 2440 bp, Homo sapiens
caattcgggagcccgttctcgcgggattttccaagaccgggttggaatttgcgggggttaggagacggaagtcagagcctaggaagatttgggggtcgccttgccggcctcctgtcctcctccggcggcggcggagcccgagagaactaggtgaacaccgctttgccagcctcacacagcgtcccctggctctgccgccgctccggacgtcgccctcccgttctgcttgggtccccttagtcgctacctttgctgggatccccctcctccatcctgtggcttcgggttgccgaagagcgatgctcggagggcggccggaagtggcgttggccgccattggcctgccggccagccaccttgctgtcctccgccgccttccgggtgttacatgcagccgggctcggcccctccccctggccggatggatccgtcggcgccacagccccgcgcggaaacctcaggcaaagacatatggcatccaggagaaagatgtcttgccccttctccagataatggaaaactttgtgaagcaagcataaaatctatcacagtggatgaaaatggcaagtcatttgcagtcgtcttatatgcagattttcaagaaaggaaaatacctcttaaacagcttcaagaagtgaaatttgttaaagattgccctaggaatcttatatttgatgatgaagatttagaaaaaccttatttcccaaaccgaaaatttccatcatcttctgttgcttttaaattatctgacaatggagactctattccttataccatcaataggtatttgagagactaccaaagagaaggaacccggtttctttatggacactacatccatggaggagggtgcattctgggtgatgacatgggacttggaaaaacagtacaggttatttcatttctggctgcagttttgcataaaaagggaactcgtgaggatattgaaaataacatgccagagtttttactaagaagtatgaaaaaggaacccctttcttctacagcaaaaaagatgttcttaatagttgctcctctttctgtcctctacaactggaaggatgaattggacacctggggatatttcagagtcactgttttacatggaaacagaaaagataatgaattaattcgtgtaaagcagaggaaatgtgaaattgctctaacaacttatgaaacactacgcttatgcctggatgaacttaacagtttggaatggtcagctgtcattgtggatgaagctcatagaatcaagaatccaaaagctagagtaacagaagttatgaaagctttgaaatgtaatgtccgcattggcctcactggaaccatccttcagaacaacatgaaggaactgtggtgtgttatggactgggctgtgccaggccttttagggagtgggacctacttcaagaagcagttttctgacccagtagaacatggtcagagacacacggcaacaaagagagaactagccactggccgaaaggccatgcaaagacttgccaaaaagatgtctggctggtttctcaggcgcaccaagactcttatcaaggatcagttgcctaagaaggaagaccggatggtgtattgttctttgacagatttccagaaagctgtctatcaaacagtgttagaaacagaggacgtgactttgatacttcaatcttctgagccttgtacctgtaggagtggccaaaaaaggagaaattgttgttataagaccaattctcatggtgaaacagtgaaaaccttgtatctcagttaccttacagtccttcagaaggtagctaaccatgtcgcgctactgcaagctgctagtacttccaaacaacaggaaacacttatcaaaaggatatgtgatcaggtattttccagattcccagattttgtgcagaaaagcaaagatgcagcctttgaaacactttctgaccctaaatacagtggaaaaatgaaggtccttcagcagcttttaaatcattgcaggaaaaacagagataaagttcttctcttttctttttccaccaagttgcttgacgtgctacagcagtactgtatggcgtctgggcttgattaccgacgacttgatggaagtacaaaatcagaggaaagactcaagattgtaaaagagttcaacagtacacaagatgttaacatttgccttgtctctacaatggctggtggactaggcctcaattttgtcggtgccaatgttgttgtattatttgatcctacttggaatccagccaatgatcttcaagccattgacagaacccaaacacattgtaggagagaaagggatgctgagcccctctcctctgctcctgggttgcagaatggaagtgagaatgcagtaccttacccctggtggtgctgtgtcacaggagcctccatttcctgctggagatgtgagatttgcaggatccaagatgtcctcgagtaa

SEQ ID NO: 2617 - DNA, 6932 bp, Homo sapiens
attctccagcaggcctgcttctggagttgggagatgtcagcctgctgggagggggtggggggaggaggaagaggtggggctctactctgattaattaccttaggcattcaggggtggggcttccttcagccatctgcctgagatatgggagggagctggagaaagaaggagggggagagactgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgcagacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcaagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacacca

SEQ ID NO: 2618 - DNA, 3469 bp, Homo sapiens
ctttccccgtcacctgcctggaacaggggtgcggggcgaggagggcgtggcgcccgtgtgcgccttctgcctgccccctcggccttcttcacttagccttcgacggccgagcgccccaggggtggcggtgggagtggggttgttgagcggcgctggctcctttcacaaatggggaaactgaggcttaaagggcgtctgactcgccagagcagctcagcctgcagctgctagcagtggcgtctcatattagcattgttgtcaaccggaggcggtgcgagtccgccggggattccagatggggctcctgcgccgcccgcctatcatttgcggcctgtattcgcgcgtcgctcccgcagagccacctcccagcaggcccacgcccgcgggggccccgggctggcgccgctgtccctggaatcgatagacggtctccttctgtcacccaggctggagtgtagtggaacgatcaccgctgaactgcagcgtcggcttcctgggctcaagcgatcctcccacctcaacctcccaagtcatggggactacagatgccatcacacctggctaatttttaaatttttctgtggagacagggtctcattctgttgcccaggcttgtctcgaaccctggtctaaagtgatcttcccgcctagcctcccaaaatgttggaattacagtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctgctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 2619 - DNA, 3294 bp, Homo sapiens
ctcgccagccgcgggttcgggcgtcttcggaccagcggggcgccgcaggcccctcgcagcgtccgtcggcaggcgggcagacgggcgggggagtcgccccggcggggcaagtccgtaccgcgacatgggcgcgccgagcacgtccgtaccgcaagatggctgctcggacggggacagagctcgcctctgccgcctcgacaactgctcctgggtcctctaagaggaggaagcgccacccatggcacacagtgtcccgtcggacagcagaaccagccgtcgtcccacgacacgaccccatgccgcccgcagggcgccccggggctcgcgtcggcccggccgtacgccaaaatggcggctcccgcgtatttccgctcgcgcgccgtatcgtcttcgccgcctgcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagctgcagccttcacatctggcctgccccgacgtcctgaacctgtccctaggtgagagctgccaagtccagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagtgttctctcgacactgccagccccgtgttagcacctgggcctcagtcccacttgctcccaggcgccggttctgtggttggtttggaattaaagtcctgtttgaagttgtcagacacagacatgaatttctgggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtgggcggcctgggcagaagggcggctggctgtcctggagctgctgctggagcctgccctcagagtgtccctttccagtgctgtggcattctgtggcagcttccccaggtgtggtgacggggggggggcggggcctccacctgtgacagccaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccagagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaac

SEQ ID NO: 2620 - DNA, 2248 bp, Homo sapiens
ggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggacgatccgtaaggctcagaaccttctgaaacagtattcccagcatggtctagatgggaaaaaggggggctctaacctcattcctctggaaggtcacgagcatgatttccgagttaagcacctgtccgaggccttgaacgacaagcacgggccgctggccgggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttg

SEQ ID NO: 2621 - DNA, 1601 bp, Homo sapiens
cgctgctcttggttctggttctggaggctgggttgagaggtcgccggtccgactgtcctcggcggttggtcagtgtgaatttgtgacagctgcagttgctccccgcccccgagcagccgaggagtctaccatggctcaagaatctcccaaaaattcagcagcagaaattccagtgactagtaatggagaagttgatgactctcgtgaacatagctttaatagggatttgaagcattcattaccatctggacttggtctctcagaaacccaaattacatctcatggctttgacaataccaaagagggtgttattgaagcaggagcatttcaaggtggccagagaacacagacaaaaagtggaccagttattctagcagatgaaattaaaaatcctgcaatggaaaagttagaacttgttagaaaatggagtctaaacacctataagtgtactcgacagattatctctgagaagctaggccgtggctcaagaactgtggaccttgaacttgaagctcagattgatatattaagggataacaagaaaaaatatgaaaatattttaaaactggctcaaacattgtcgacccagcttttccagatggtacatacccaaaggcaacttggagatgcatttgctgacctgagtttgaagtcactagaacttcatgaagaatttggctataatgccgatacccagaaactgctggctaaaaatggagagactcttcttggggccattaattttttcattgctagtgtgaacactttggtgaataaaaccattgaagatacattaatgactgtgaaacagtatgaaagtgccaggattgaatatgatgcatatcgcactgatttggaagaactgaatcttggaccacgtgacgcaaacactctgccaaagattgagcagtcacagcatctcttccaagcacataaggaaaaatatgataaaatgcgcaatgatgtttctgtcaaattgaaatttctagaagaaaataaggttaaagtattgcacaatcagctggtccttttccacaatgccattgccgcttactttgctgggaatcagaagcagcttgaacagacacttaaacagttccatatcaaattgaaaacccctggagtggatgccccatcttggcttgaagaacagtaaaatcacagcggaaaataaaaagaaagtcgcgttgttatatttctaaaccaacctaacaagaattaagcagagttgggggaagtgggaggggtgacaagcattatagtgattcttgcacaaacagctttaatttttccctttttcatactttaacaattgaactgttaagggtggttttaatgtaaacatagtttctataatctgaacacaataattttcctttttgagaaatccttttgtattgtgagggttgatggctatttctgtagtttgaaaacatctaatagagatttgcactgacaagataaaaattcaaggtttttggtcctggaaatgagggccgattgtaacttttccaaagggaggtttacatgatttgtatcaacatcagatattttatatgtgaatatattaaacatctttaagagattcattttcatgtatt

SEQ ID NO: 2622 - DNA, 2011 bp, Homo sapiens
gtgcgcgctacatggccggagtcgggcgaagcgggggaccgtggggaagaacgcgaggagggaggagtgggaggttgggggtgtcgctaggcgcccttagctccctccctctggaggagctgccgcggccactctgctgccgccgctgccgccgccattttgggttcgctttgcgaggggaaacgatcccagtgtcggttgcgggatccgcctcctctcagtttgcccctttagccctccacctttcccttctcctctctcgcatttccgccagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggtacagccctcttcctcgaagtctgtaggaggcagaaggtcactgaaagttctgagagaatatcaaggacttccttaatcgtctaatgctttagttgtagaactaggacttcaggaatcttcctgattcacctttcttcccttacttttctgcccttctccgggtgattctacaacattttcaaaataatgggtaaaatggtaatttgctaaaggaaattcagagaagagtttctaaagtgtataattggactgtggtctttgtagaaatttcatatgcagagtcccttggaaagatgccttgagcttgtctcaggtccctaaacttagaaagtcctattctttttcccaaattctgacatgtgctggatcagagtgttctcatttccaataggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccg

SEQ ID NO: 2623 - DNA, 936 bp, Homo sapiens
taggccggggccggcggggcccggaaggcgacgggaaggagccgagcttgggttatggcggcgccgggcgcgctgctggtgatgggcgtgagcggctcggggaactgggatggaaattctatgatgctgatgattatcacccggaggaaaatcgaaggaagatgggaaaaggcataccgctcaatgaccaggaccggattccatggctctgtaacttgcatgacattttactaagagatgtagcctcgggacagcgtgtggttctagcctgttcagccctgaagaaaacgtacagagacatattaacacaaggaaaagatggtgtagctctgaagtgtgaggagtcgggaaaggaagcaaagcaggctgagatgcagctcctggtggtccatctgagcgggtcgtttgaggtcatctctggacgcttactcaaaagagagggacattttatgccccctgaattattgcagtcccagtttgagactctggagcccccagcagctccagaaaactttatccaaataagtgtggacaaaaatgtttcagagataattgctacaattatggaaaccctaaaaatgaaatgacaatgattttgtatcagtggtccaaacagaactaagcataaatcattgtgccatcccaaacctcgttccagccgccttgcccatactagattctaaatgtttctaaaggcaaaccccaatgtgtcaagacagacttgtttaggtgtaattttaggaattatgctggttcatcaggaagcagagggggagttttaaaagtcaagcttaaattgaagtttaaattcatctataaccaaatcaaatgatcagaggaaattctgtaatcaatgctggaaatcgttacattgtttagaacattcttgctcatgcctgtatttgcacaaataaatgaaacttcgctgtccttggc

SEQ ID NO: 2624 - DNA, 631 bp, Homo sapiens
aaattctcgtcaacgtccggtgagggggcaggacttccttgctggttgctaagacactcttgtttcgctccttgacaaccctggcgggggttcgctggctgcggccccggctccggcccccgcaggagcagcaccccccggggaaagacattttctgctcccaccgagttggcagggcctgcttcctgaatctcctgggtgtgtcttaactgccagtcccagcacctcctgaaagccccactctcctccagtggtcacagtggaaggatcatgggagaaacagaagggaagaaagatgaggctgattataagcgactgcagaccttccctctggtcaggcactcggacatgccagaggagatgcgcgtggagaccatggagctatgtgtcacagcctgtgagaaattctccaacaacaacgaggtattgccagcagtgcaggcggcccctcgtgcttttgatggcccctgtgggtgaataaagtggcccctgttccctgcagttggctccagacagtactgctaggatgaggccagagccttccttggaagcattcagtctggggaaagtcagtgagtgagaggctggcgctgactccaggcactgacggtcacacccagccctagaggag

SEQ ID NO: 2625 - DNA, 6746 bp, Homo sapiens
ttgtttgatggttttgatgtttcagattcgttatatttcacaaacacaaggcttgccagctgaatatcttctcagtgccggaacaaaaacaaccaggtttttcaacagagatcctaatttggggtacccactgtggaggcttaagacacctgaagaacatgaactggagactggaataaaatcaaaagaagctcggaagtacatttttaattgcttagatgacatggctcaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcatgttaagtcttgttttcagaacatggagatctgcaagcggagggttcacatgtatgatacagtgagtcagatcaagagtcccttcactacacatgttgccccaaatacaagcacaaatctaaccatgagcttcagcaatcagctcaatacagtgcacaatcaggccagtgttctagcttccagttctactgcagcagctgctactctttctctggctaattcagatgtctcactactaaactaccagtcagctttgtacccatcatctgctgcaccagttcctggagttgcccagcagggtgtttccttgcagcctggaaccacccagatttgcactcagacagatccattccaacagacatttatagtatgtccacctgcgtttcaaactggactacaagcaacaacaaagcattctggattccctgtgaggatggataatgctgtaccgattgtaccccaggcaccagctgctcagccactacagattcagtcaggagttctcacgcagggaagctgtacaccactaatggtagcaactctccaccctcaagtagccaccatcacaccgcagtatgcggtgccctttactctgagctgcgcagccggccggccggcgctggttgaacagactgccgctgtactgcaggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaagtgaagcccctctttatttcattttgtgttattgtgattgctggtcaggaaaaatgctgatagaaggagttgaaatctgatgacaaaaaaagaaaaattactttttgtttgtttataaactcagacttgcctattttattttaaaagcggcttacacaatctcccttttgtttattggacatttaaacttacagagtttcagttttgttttaatgtcatattatacttaatgggcaattgttatttttgcaaaactggttacgtattactctgtgttactattgagattctctcaattgctcctgtgtttgttataaagtagtgtttaaaaggcagctcaccatttgctggtaacttaatgtgagagaatccatatctgcgtgaaaacaccaagtattctttttaaatgaagcaccatgaattcttttttaaattattttttaaaagtctttctctctctgattcagcttaaatttttttatcgaaaaagccattaaggtggttattattacatggtggtggtggttttattatatgcaaaatctctgtctattatgagatactggcattgatgagctttgcctaaagattagtatgaattttcagtaatacacctctgttttgctcatctctcccttctgttttatgtgatttgtttggggagaaagctaaaaaaacctgaaaccagataagaacatttcttgtgtatagcttttatacttcaaagtagcttcctttgtatgccagcagcaaattgaatgctctcttattaagacttatataataagtgcatgtaggaattgcaaaaaatattttaaaaatttattactgaatttaaaaatattttagaagttttgtaatggtggtgttttaatattttacataattaaatatgtacatattgattagaaaaatataacaagcaatttttcctgctaacccaaaatgttatttgtaatcaaatgtgtagtgattacacttgaattgtgtacttagtgtgtatgtgatcctccagtgttatcccggagatggattgatgtctccattgtatttaaaccaaaatgaactgatacttgttggaatgtatgtgaactaattgcaattatattagagcatattactgtagtgctgaatgagcaggggcattgcctgcaaggagaggagacccttggaattgttttgcacaggtgtgtctggtgaggagtttttcagtgtgtgtctcttccttccctttcttcctccttcccttattgtagtgccttatatgataatgtagtggttaatagagtttacagtgagcttgccttaggatggaccagcaagcccccgtggaccctaagttgttcaccgggatttatcagaacaggattagtagctgtattgtgtaatgcattgttctcagtttccctgccaacattgaaaaataaaaacagcagcttttctcctttaccaccacctctacccctttccattttggattctcggctgagttctcacagaagcattttccccatgtggctctctcactgtgcgttgctaccttgcttctgtgagaattcaggaagcaggtgagaggagtcaagccaatattaaatatgcattcttttaaagtatgtgcaatcacttttagaatgaatttttttttccttttcccatgtggcagtccttcctgcacatagttgacattcctagtaaaatatttgcttgttgaaaaaaacatgttaacagatgtgtttataccaaagagcctgttgtattgcttaccatgtccccatactatgaggagaagttttgtggtgccgctggtgacaaggaactcacagaaaggtttcttagctggtgaagaatatagagaaggaaccaaagcctgttgagtcattgaggcttttgaggtttcttttttaacagcttgtatagtcttggggcccttcaagctgtgaaattgtccttgtactctcagctcctgcatggatctgggtcaagtagaaggtactggggatggggacattcctgcccataaaggatttggggaaagaagattaatcctaaaatacaggtgtgttccatctgaattgaaaatgatatatttgagatataattttaggactggttctgtgtagatagagatggtgtcaaggaggtgcaggatggagatgggagatttcatggagcctggtcagccagctctgtaccaggttgaacaccgaggagctgtcaaagtatttggagtttcttcattgtaaggagtaagggcttccaagatggggcaggtagtccgtacagcctaccaggaacatgttgtgttttctttattttttaaaatcattatattgagttgtgttttcagcactatattggtcaagatagccaagcagtttgtataatttctgtcactagtgtcatacagttttctggtcaacatgtgtgatctttgtgtctcctttttgccaagcacattctgattttcttgttggaacacaggtctagtttctaaaggacaaattttttgttccttgtcttttttctgtaagggacaagatttgttgtttttgtaagaaatgagatgcaggaaagaaaaccaaatcccattcctgcaccccagtccaataagcagataccacttaagataggagtctaaactccacagaaaaggataataccaagagcttgtattgttaccttagtcacttgcctagcagtgtgtggctttaaaaactagagatttttcagtcttagtctgcaaactggcatttccgattttccagcataaaaatccacctgtgtctgctgaatgtgtatgtatgtgctcactgtggctttagattctgtccctggggttagccctgttggccctgacaggaagggaggaagcctggtgaatttagtgagcagctggcctgggtcacagtgacctgacctcaaaccagcttaaggctttaagtcctctctcagaacttggcatttccaacttcttcctttccgggtgagagaagaagcggagaagggttcagtgtagccactctgggctcatagggacacttggtcactccagagtttttaatagctcccaggaggtgatattattttcagtgctcagctgaaataccaaccccaggaataagaactccatttcaaacagttctggccattctgagcctgcttttgtgattgctcatccattgtcctccactagaggggctaagcttgactgcccttagccaggcaagcacagtaatgtgtgttttgttcagcattattatgcaaaaattcactagttgagatggtttgttttaggataggaaatgaaattgcctctcagtgacaggagtggcccgagcctgcttcctattttgattttttttttttttaactgatagatggtgcagcatgtctacatggttgtttgttgctaaactttatataatgtgtggtttcaattcagcttgaaaaataatctcactacatgtagcagtacattatatgtacattatatgtaatgttagtatttctgctttgaatccttgatattgcaatggaattcctactttattaaatgtatttgatatgctagttattgtgtgcgatttaaactttttttgctttctccctttttttggttgtgcgctttcttttacaacaagcctctagaaacagatagtttctgagaattactgagctatgtttgtaatgcagatgtacttagggagtatgtaaaataatcattttaacaaaagaaatagatatttaaaatttaatactaactatgggaaaagggtccattgtgtaaaacatagtttatctttggattcaatgtttgtctttggttttacaaagtagcttgtattttcagtattttctacataatatggtaaaatgtagagcaattgcaatgcatcaataaaatgggtaaattttctga

SEQ ID NO: 2626 - DNA, 3094 bp, Homo sapiens
gggcggacggtcggagtccggaagaaaaacagtccgcgacagctaggcgcgtgagaccggccgcccgcagggctgctctggccgggacccgctggccgggagacgcgaacctgccggaccaccgcgcggggacgacggcggccatgagctcgcggaagctgagcgggccgaaaggcaggaggctcagcacatacatcaggaggtctgcctgatcccatggtgaaccccgggaatccgaaatcagattgagataagatcctttagggaagtgacttagcctggtctcttgcctgctctttcacggggaacaacgctaatcgcccacttagtctaagtcacgatgcttggatttgctgctaatcgtcggatttgagagtgggaacaagaaatccggacttttgctctccatcctcttagaatctccagctgctgcaggtactcctcatcgtgtgcctaggactcatgctaggctgttcctggtctctgcagggtctgtagctcctgcccgctctgtgctccgcacagtctgaggcttcttgaagagctgctgtgactgactgttccactaaagacatctcatacacgtcgtgacttggaacgtggcttcggcagcgccccctctagatctcagtgacctgcttcagctgaacaaccggaacctcaatcttgacatatatgttattggtttgcaggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacctggggacagttctgcgtctcatttctggattcctaccccctcttctagtcttgcccaagtagtcctgccaggcacatgccccatttggcacaggcctgcattcttgtcgtgccgtcctgggcctcaggctgtctgggaggggagatgctcacatttgtacaggctacatagactggtgcaagcagtgctggattccaggagtcttggcatctcatagcttgtccccgtgaggagtgagcagagggtctgggatttctgctttcagcaaaagcagtctgactcagtgggcagaatggaggggcccctctagccaggctcttacgccatggttatgagcaggttgatgagggtccttcggccagcacaaccttcctccctactcacggcatggagtctgactgcatggaagttccagatcctgacagagagaactgggaaggatccaggttcgcttccgttggtagcttgagtcccatgcctccaccctgccatctgaggaaggggtgacaagtggtcaaggagctgtggccacagacttttccagggtggtccttggcaggtgaggtgcgtctgtgccacccttgtcaggagccattgacgacgggccccccctggaccccccgggacctcagagtgggggcaggcagaagggagaaccagctcaagacattttggaggatctggccctggggttcttcagagaacaccctctaggggctttggggacatggcctgtccccacatccagcacttgcctccgccatggtcactcggcagcccttttcccaggagaagacacctctgggagcctgctcagtgcttgtcctgccatcctgtgtcctgggactgagggttactccagttgctctgtgttgcatactctcccccgcaagcctgtgtatgaagaattgtcccctggcttccagcaggccatggctggctgttttgtgactgttaca

SEQ ID NO: 2627 - DNA, 718 bp, Homo sapiens
gaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtggtaaggggtccgcagaataacgtgagaagcttggggatatcagtctctgccctggtctcatgagggacatggagccagcttgaggatgtatgcagtagaatacacagaaggatatagcacagtacatcctataggcattaggatctctgcttcaagaattgcacattttttattattaaaaattctttattataaaacttgttaatgtattataaaaattaaattataaattacatataaaatataaacttaacatttg

SEQ ID NO: 2628 - DNA, 243 bp, Homo sapiens
atggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggatgggatcagtcagataagtttgtga

SEQ ID NO: 2629 - DNA, 1133 bp, Homo sapiens
actcccagactccttgcggagctcgccgcctgattctaggctggtcactactccgagcctgtgacgtttgcggcagccaggccgtcgacgatgcccagtgaaactctctgggaaattgcaaaagctgaagtggaaaaaaggggaattaatggaagtgaaggtgatggagctgaaattgcagaaaaatttgttttcttcattggcagtaaaaatgggggaaagactactattattctaaggtgtcttgacagagatgaaccaccaaaaccaaccttagctttggaatatacatatggaagaagagcaaaagggcacaacacaccaaaagatatcgctcacttttgggaactcggtggaggaacctctttattggacttaatcagcatacccatcacaggtgacaccttacggacgttttctcttgttctcgttctggatctttcaaaacctaatgatctctggcccaccatggaaaatctcttgcaagccacaaaaagccatgtagacaaagtgataatgaaactgggaaagacaaatgctaaagcagtttctgaaatgagacagaagatctggaataatatgccgaaggatcatcctgtgagttgctgtttgggattattactggaatccttagtcccatttatagttaatgataacatcacaaacaacttctttagatttttatgcatgacttgaaattcatttgatgtagatgaacctgttcactggaaaattacagcaatttattaaaacctcagtaagagcaaaacaaggaagaagattccttatatcttcttgttagacatcttctgtgattgttatggcatattacaccaatcagagaaatagagttttaaagtagtggtttgatattgattttataatctctgtaaaaatgaagataaaaagccagattgtacaaaagtcacctgacaaagactagatgaagctacaactttaagcaaggggtagagttgtaatagccttcaccatcactctgtattttacattcatttcgtttctgtcacttattcagtatctttttatcatctgacagctaattaaattataaagttgctatgatggtaacacaagttcttcaaatacaataataaatatcatcatctggaaaa

SEQ ID NO: 2630 - DNA, 2282 bp, Homo sapiens
aggtaaggtggccgtaagggcgcggtgggctccacgacggggtgatctctgggaccactggatgtgggtcccggcgcgaggcagcttccgggtcgcggccagctccggccgacctcccgcccggccctcaggctgctcccacagttcccggtccctagacaaccctggctctgcccgcccacttcgcgtgttcgattggcttgtccttcccctttctaagaccggagactaaggcctgttagacgtttctgtgtttctgcacctgagtttttttggtctaggctccgtctggtcaaatctcgctgattcccacagcctcttgtcctttgctccacctcattgcacccgtaatgttgtattgtcattgtctgtttactgtcccttttctctaaggcgtgtgagttcctcaaaggcaggcacagtgtcttattcgcctctgtatccttagctctctgcttggcatctagactctaggatgagcgttttgaattcacgacttggcggctgtccttgactgtgtctctttccttctaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccag

SEQ ID NO: 2631 - DNA, 1913 bp, Homo sapiens
caagtctctggacaaacctgaacagttcctttatgaactgtcactaatccccaacttttcagagcgagtcttttgcatcctgttccagtccacattttcagaaagcatttgctcaattcgtcgcaaactggaattactacagaaattgtgtgagacattaaaaaatggcccaggggttatgcaggttctaggtttggttcttgcctttggcaactacatgaatggaggaaataagactcgaggacaggcagatggctttggattagacattcttccaaaactgaaagatgtcaagagcagtgacaatagcagaagccttttgtcatatattgtttcgtattatctccgaaattttgatgaggatgctggaagaacagtgcctctttccactgccagaaccccaggacctttttcaggcctcacagatgaagtttgaagattttcaaaaagatctcagaaaactgaagaaagacttgaaagcctgtgaagttgaagcagggaaagtataccaggtctcctcaaaagagcatatgcagcctttcaaggaaaacatggaacaatttattattcaagccaaaattgaccaagaggcagaggaaaattcactgacagagactcataaatgctttttggagaccacggcatatttcttcatgaaaccaaaacttggagagaaggaggtgtccccaaatgctttcttcagtatctggcatgaattcagctctgactttaaagacttctggaagaaagagaacaaacttcttctacaagagagagtaaaagaagccgaagaggtgtgtagacagaagaaaggaaaatcactttataaaataaaaccaagacatgactctggaattaaagcaaagataagcatgaaaacttgaacaatgaaaagcagaatgaaaatgagtcattgcaacgactttcacaaaattcagctgacctgagagtgggagggaaactaccgtcattctgctcatgtttcttcttgacctcttgcataatctttttgttttctagacagttcactaattgttgaattttactgtatattcatataaaaatgcaaacgtactagaccagtggagaatttgacaccttttctttttgtaaaagtttatggtattataccgatagaccaaaacagcatgtgtaagaggcagtatctgcactaattctcaacatgctaaacattaactacaattcactgttgtgagaatattcctcgtcacagcaaaaacactttcctttctactgacaaccagtcctccacatcacagcatttagacatatgggtaaaatgttatttctagtgaattgtttgtatcagtttcatgtctaagtataaattttctattttaaaatttaagaaccgtttataatcagtgctttcccaactcttgggttgctctccataactatgtatttgtgaaagaaaatggtcattttttttactgaagtcatataatgacttgggtcagctcgtaatgcattgtgatggttttgtatgagctgggtgtttttttccattacttttaatgatcttcgttgcaagttatagttgtggataaaggggagaatttattgctcttgcaaaccaattatggaaagcaacttaagaaaaccaatgttctaaatcataattgtttgtatttatgtaaagtatggtctcttactttttagtttgtagtttaagtgcaaagaaacagtagtggttttttttctattgttttgtagtcttcctgtccccttcagtccctccagtgtgtatattaccattctccaatgaaataatagggcatttaacaaagatcgctatgtgcaatactgtatttagtgtttctatttcaatttttctaggatgttaatttatatgaaaataaaatgaataataaaagaataaagatacttgc

SEQ ID NO: 2632 - DNA, 1078 bp, Homo sapiens
gccaaatcttaaaggatccgggagctaagccagacccgggtggcggtggcagctgcgaaacccagggagccgatgccacgtgacccaatgtggacttcttttaaacctttctaatgcccataacccagcctcagacccatggagcccacgagagactgcccgctgttcgggggcgccttttccgccatcctccccatgggggccattgacgtaagcgacctccgaccggtcccggacaatcaagaagttttctgccatcccgtgacggaccagagcctgatagtggaacttctcgagctgcaggcccacgtacggggcgaagcggctgcgcggtaccactttgaggatgttggtggcgtgcagggggctagggctgtccatgtggagtctgttcagcctctcagtttggagaacctggccctgaggggccgctgtcaagaagcctgggtcctctctggcaagcagcagatagctaaggaaaaccagcaggtagcaaaggacgtgacacttcatcaggccttgctgaggctgccccagtaccagactgatctcttgcttaccttcaatcagcccccgtaaggaggaaggaacgggcgggtatctcatgactgggttcccaggagaatcgggctgggagggacagaacagggagactcactggtgggatcctccaaggaagcaggagtgggccagaggtttggggtaactgatacccaggtcctctggggaacaggaattggcaatttccaaacctcaggcctggatgatgttctgtctccatctgttcccccaccccaagccctgacaacaggtcatctcttggccccgaaaatctgtcacctgcaccctggagcctgggtgactttgaacagctggtgaccagtctgacccttcacgatcctaacatctttggtccccagtaaaggcgctgaagcactgcatgatgttgctgagaacttggggactcggttctgtgagggggaaaagaggttgaaaagagggtttcctcttatttcttccctgtgcgtaaacataagacaatccctcttcagaataaacttgctttataatcaatata

SEQ ID NO: 2633 - DNA, 4047 bp, Homo sapiens
ccccggctctctttctcctctctgtcctgctgtcgcctcctctcctcactccagcctccttccctggcttattctgcccaggaaagtttggaacccccgccccccctccccaatcaggtcaacctgactaggagtagggggagatgtaggaaggcctgagagttcggggggggggaagctggaagctggtttcccagaaaatttccccccatcttctccatttagggtggtgggaattttttttaatcctgtttttgaggaggtggtaggtgtttagaaaaggatgtgggaatggaaggggtagatgagtcaaccctctttcaagattccaagggtggtgtgttacctgatccttttcgtgtgtggagttcagggggtcgggaggtttggcctttattcccacattcaaagttggaacctcccccaaattaagaatggagttttagtacccacttgtggcaggaatcctggggggaaggggtccttttttcctttttcttttcttttttcccttttttttccttttggcaacccacacccttccacacacgctcaccccaaaattaaacaccaagatcctctaacttgtttggattgactgatgaagacataaagctctatgttttttgaggtggagtgagtggtttttcttcatttttaaatggccaaatgacagcttgacccagtttgctttccaatcaaagggcatttattttgaatgtctctttgtggcgcaagagccaacgcaaaaatgatggcggcttacaatggcggtacatctgcagcagcagcaggtcaccaccaccaccatcaccaccaccttccacacctccctcctcctcacctgcaccaccaccaccaccctcaacaccatcttcatccggggtcggctgccgctgtacaccctgtacagcagcacacctcttcggcagctgcggcagccgcagcagcggctgcagctgcagccatgttaaaccctgggcaacaacagccatatttcccatcaccggcaccggggcaggctcctggaccagctgcagcagccccagctcaggtacaggctgccgcagctgctacagttaaggcgcaccatcatcagcactcgcatcatccacagcagcagctggatattgagccggatagacctattggatatggagcctttggtgttgtctggtcagtaacagatccaagagatggaaagagagtagcgctcaaaaagatgcccaacgtcttccagaatctggtctcttgcaaaagggtcttccgggaattgaagatgttgtgtttttttaagcatgataatgtactctctgcccttgacatactccaacctccacacattgactattttgaagaaatatatgttgtcacagaattgatgcagagtgacctacataaaattatcgtctctcctcaaccactcagctcagatcatgtcaaagtttttctttatcagattttgcgaggtttgaaatatctccattcagctggcattttacatcgagacattaagccagggaatctccttgtgaacagcaactgtgttctaaagatttgtgattttggattggccagagtggaagaattagatgaatcccgtcatatgactcaggaagttgttactcagtattatcgggctccagaaatcctgatgggcagccgtcattacagcaatgctattgacatctggtctgtgggatgtatctttgcagaactactaggacgaagaatattgtttcaggcacagagtcccattcagcagttggatttgatcacggatctgttgggcacaccatcactggaagcaatgaggacagcttgtgaaggcgctaaggcacatatactcaggggtcctcataaacagccatctcttcctgtactctataccctgtctagccaggctacacatgaagctgttcatctcctttgcaggatgttggtctttgatccatccaaaagaatatccgctaaggatgccttagcccacccctacctagatgaagggcgactacgatatcacacatgtatgtgtaaatgttgcttttccacctccactggaagagtttataccagtgactttgagcctgtcaccaatcccaaatttgatgacactttcgagaagaacctcagttctgtccgacaggttaaagaaattattcatcagttcattttggaacagcagaaaggaaacagagtgcctctctgcatcaaccctcagtctgctgcttttaagagctttattagttccactgttgctcagccatctgagatgcccccatctcctctggtgtgggagtgatggtggaagataatgtactactgaagatgtaatgtagctttccactggagtctgggatttgcaattctggaggttaatcatgcttgtactgtaattttactaatgaagttttaaattaacaaccactacttgtatgatatgaataatatttagaaatgttactagacttttaatcttgtaaagtggttgtgcttttagaagaaaaatattttacccagagttgcacatgttttatgaatttagtgcagctgttatggctcacctcagaacaaaagagaattgaaccaaatttgggagtttggggttttatgttttgtttttcttttctaaaatgaagtgagattgttcacacacacacacacacacacacacacacacaaacacaaaggacagtcatacattttgatatttgagccattcctaaagatttggggttttctaaaactaaagaatctaggaaccttgcctgcgaccaatcatggagccacgtgagctgatcgtggctgcacctggggggagggtagggaggaggggcatgccacctaatgatcaagccctataattagcttctcattagagccgtgatggtgatgtgtgctgtctaaaatccaatgttgtgggtagagagaatgagtttgtgactaggagagactaaacttttgttttccttacccagtataaatatatatatatatatttaatctatttttattagaagtttttctgctctttcttacataaaagaaccccaagcatgcatctttcatgtgtgtaaataattcatttctgggctaatttcaaaagaatcccaatattgctgtatagaaagagaactagcttgcacattttaggtctgtgaaattttgtgagacttttcctgcactggacagtaaaaaaataataaaagacaaaaacaaatttaaaaaaaaatttaagccacaaaaaaaggcacatagggaattatgtcaaatgtgtttgtgtccttaggcaaagctgtgggagtcttgaaatgtcacagtagtaaataacttattactttttgacaagttctttttttctgttggaacactgaattcttctgtgcatatgtacatatgaatacaaatcgaaggcctctacctcctggagttatacaacttggcttgtttacctccacatgctgatgatgactattttttttttttgagttcagtgtggagacttgaaacttgaatgtcccttccaacttttatattaaaaataaaaagacaagaaaattgaagatcatttttcacctgtacaaggaatactaatggatcgtcttaaaattggtctaggaaaaaaccttggtgtgtgttatggacaattaactgttaaagttattgtaagttatctgtatttagcagagtattttcaacttgagtgatctgagctgaatttgaagactattaataagttatgtttggaagttttaacttcaatgaagtaattatttgctgtgaaagaaacaaacattgaattactaaacaaagatggtgcaatatctttgttttttttttatgaggctcctgagaatcaacccaactgaagcatttcaattcacttgaatgagaaacgtgtttagtatcaaaagagcccaagaagacactggtgtgaaaggtacaatctcagaggttggtcaattaccgtggcacactttctggtcactttgtacaatgtagatttgaagtacagtggtgaaaacattaaatgtgacatttgaaaaa

SEQ ID NO: 2634 - DNA, 3563 bp, Homo sapiens
ggttccgctgaggcgtggtaggaagtggctgccgtcaatcactcggggagactccaaacagtgagcctagagctggagactagcgttaaccggcggggcggccggttttatgaatgaagctatggctacagattccccaagaagacccagtcgttgtactggtggagttgtggttcgcccccaggctgtcacagagcagtcctacatggaaagtgttgtgacttttctgcaggatgttgtgccacaggcttacagtggaacacctctaacagaagaaaaggagaaaatagtctgggtcagatttgaaaatgcagatttaaatgatacatcaagaaatctggaatttcatgaaatacatagtactgggaatgaaccgcctttgttgattatgattggctacagtgatggaatgcaggtctggagcatccctatcagtggtgaagcacaagagctcttctctgttcgacatggcccaattcgagcggctagaatcttgcctgctccacagtttggtgctcaaaaatgtgataactttgctgaaaaaagacccctccttggtgtttgtaagagcattggatcttctggcacaagcccaccgtactgttgtgtggatctgtattcacttcgtactggggagatggtcaagtccattcaatttaagacacctatttatgatctccattgcaataaacggatccttgtcgtagtcttgcaggagaaaattgctgcctttgatagctgtactttcacgaagaaattctttgttacaagctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccggcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcatgggaagagtttgtctttcttatctttaagcccctttaccctggtcctgtactgatcagtgaaggaaaccgtggttactgaggccctgttgaaaagtgcacgtcttgtccaataaatcacgctgcagttggtgtccatccctg

SEQ ID NO: 2635 - DNA, 2705 bp, Homo sapiens
gtagggtgggggtgctggcggcggctgctttggcggcggttggtggccgtgcgggcggggagggagggggaggagagaagaggaggtggagaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactgtgagtaatgatcctcaagtgagaacatgggattttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaacaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 2636 - DNA, 818 bp, Homo sapiens
tcagggcggtttgaaagatcggcgcgcaccgcaggagcaacggttggtcctgcggctgtgatgtcggtgttgaggcccctggacaagctgcccggcctgaacacggccaccatcttgctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacagtctccagaacacagaggagtccctgcgccatgtggatgccagcttcttcttggggaaggtgtgtttcctcgccacaggtggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaa

SEQ ID NO: 2637 - DNA, 1792 bp, Homo sapiens
atttgcccaggagcaagctcccctgcactttccatgtttgtattgggcatccctttgtgccctgccctttctttctcaggaggggatgatagccagactcaactttttgtttcatctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaaggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctgctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtg

SEQ ID NO: 2638 - DNA, 2900 bp, Homo sapiens
gaactgggccaagcgcccccggaggcgctaagcttgcgccctgaggcggtttccgttcccggacgtttggactctgtcctggagaaggggaaggaaaaagtaagacgtagaagtacactgagacttcgtcacacataaaacaagcacgacaaagaaagagggcgcgaagggactcctggaagaaattgagtctacatttaagatcaccctaaaagtagtgacggcctcttcattactccaaaccccagatttaagtcggtaggacgtcttcgcgttgacttgtggggaatgtagtttcgatgctgccggcgcgttttgtttgcgacagaaactacaacccccaggggccaccgcgacgttgcctgtgggtgcccgcgaaccaacggttagcggtggcaggggctgactgagagcgtctgcttgtgcctggtacctagtacaaacttaataaatgtgtgacgcaagaataaaggaatgaatgaatggaagaatgatataatgccacagaactttcaaagatgggactgtctagttgcaaaaacaagctcagggatcccactgattctactttacgataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttctgg

SEQ ID NO: 2639 - DNA, 1978 bp, Homo sapiens
acggaagcggtgagactgtctctcggctgcagccctggtgcgacccggcccgttgccgtagagatgggcagggctggatggagtggggtgcggtgagctgagctgaccctgcttcgccacggggactgcagtgaccccggcttgccggcagggcgggtaacaggttgagccagggtggggctgctcaggggcgtggagccgaggccaggatttctctgaagacccggcacaggctattcctttctgcgacgagcccattgctatggaaaccaaagcgttaggccagcggggattgaggctgcgggatcatgacgggtctctctcccgaagaaccttgcctaaggcttccccaagcggctacttcctgagcgaacccgcccacccgcctgaaggagagaggtaaaaccctgggggtcctgacactaagcaggcgaagaagcctattccaatgccagctcccctaggaaacctacccggcccacccctagaagtgatgcttcgctctcgttaactcttggactttgttccatgtttataacttagtatttcacgaacgccccgcggtgtttgttcatttttcccacacataatggaccataaaggtcggcttctttgctttatgactcgttctgaacaagtccttttccgcgctgtgtctcactttcctcttttgtaaaatggaaatattaactctagacgccggtctgattaggttgctttgaagatcgaaccagatgagggaagccaaatacttcataggctgtaaagtggtgaagctgaactgctaccgagttgctatttttttctcctcctccctctcaagctaaacgttctttagatcttttgtgatttcttcaggtggtctttgcgactccctaggctccgacctggaagaaatcttttttacacttccctttcacagagccctgcattttaacttccctatcagaagcgagaaaaatagttatcattttgagagggcttactctatgccaagccctgagaaaactctttacgtggattatctcgtttaatttcacaacatccttttaagttttccatggacacagcctagcagaaagacgcagccttcgtgcttcgctgactgctgaccactgacccaccgccttgatgacagcaccctcgtgtgccttcccagttcagttccggcagccctcagtcagcggcctctcgcagataaccaaaagcctgtatatcagcaatggtgtggccgccaacaacaagctcatgctgtctagcaaccagatcaccatggtcatcaatgtctcagtggaggtagtgaacaccttgtatgaggatatccagtacatgcaggtacctgtggctgactcccctaactcacgtctctgtgacttctttgaccctattgctgaccatatccacagcgtggagatgaagcagggccgtactttgctgcactgtgctgctggtgtgagccgctcagctgccctgtgcctcgcctacctcatgaagtaccacgccatgtccctgctggacgcccacacgtggaccaagtcatgccggcccatcatccgacccaacagcggcttttgggagcagctcatccactatgagttccaattgtttggcaagaacactgtgcacatggtcagttccccagtgggaatgatccctgacatctatgagaaggaagtccgtttgatgattccactgtgagccatcccacgagcccctgcattggagtcagagcccctgcccttgatggatcagctggcaccacccagattgataaactggctcgtctgatcttgtggcccccacccaggaactgactgggcactagaaaacagcttcaacatcctgtgatttcatccctgaccaatcagcactcctgtctcactggcttcccccaacccaccaagttgtccttaaaactctgctccctgaatggtcggggagactgatttcagtaatagtaaaactctggtctcctgca

SEQ ID NO: 2640 - DNA, 2109 bp, Homo sapiens
cagaaattagataacatcctaaatccaaaagaaaagcatattttttataaaagtgagaagattttagaacagaatatttcttccaagtctgacgagaaaaaaattaaaaatacagataaacattgcattttacagaatgtcacagaatcagaagatagtgatgtcatctgtcctacacaatacacaactgagagattccccgacaatagtataaggtttaagccacccttggaaggatctgaggattctgaaacagaacacactgtaaaaacaagaaataatgataatagtcgaaacactgatgacaaaagaaatggaataatttcaaaaaagttaagtcctgagaacacaaccctgaaatctattttgaaaagaaaaggcaccagtgatatcagtgatgaatctgatgacattgaaatttcttccaagtcaagagtaagaaagagagctagttcattgaggtttaagagaataaaagaaaccaaaaaagaacttcacaattctcccaaaacaatgaacaaaacaaaccaagtgtatgcagcaaatgaggatcataactctcagtttattgatgattattcatcctcagatgagagtttatccgtcagccacttcagtttctctaaacagagccacagaccaagaactataagagacagaactagtttttcttcaaaattgcctagccataataagaaaaatagcacttttattccaagaaaaccaatgaaatgttcaaatgagaaagttgttaatcaagagcagtcgtatgaatcaatggataaatttttagatggcgttcaggaagtggcttatattcactcaaaccagaatgtaattggatcgagcaaagctgaaaatcacatgagccgatgggcagcacatgacgtatttgagttgaagcagttttctcagctgcctgctaacatagctgtttgcagttctaagacatataaagaaaaagtggatgcagatacattgccacacacaaagaaaggccagcaaccgagtgaaggcagcatttcacttcctctttacatttcaaatcctgtaaaccagaagaagaaaaaagtctaccatacaaaccagaccaccttcataattggagaaacaccaaaaggaatccgcagaaaacaatttgaagaaatggcctcttattttaactcgtcttctgtaaacgaatttgctaaacatataaccaatgccacatcagaagaacgacagaaaatgctaagagacttttatgcttctcaatatccagaggtaaaagaattttttgtggattctgtgtcacaattcaacaattcttcctttgagaaaggagagcagcgcacccggaagaaatctgataaaagagaatctcttataaaaccaaggctgtcagattctgaaaccttgtcatttaaagattctaccaacaaaatttctcaagtttgcagcctaaaaacatataaaagaaaatcagttaagtttcagaatcatatttcctatagagaagaggtgttttttaatgatgcagaaactaagaaatcacctgttagttctactcaagagattgacagtgggaaaaacagccaggcatccgaagatactgtgacatcccgttctctgaacagtgagtctgaaacacgtgagagaaggttagaaaataccatgaaagaccaacaggacctcacaagaacgggcatttcaagaaaagaaccccttctcaaattggaaaacaaaaagatagaaaatccagtgctggaaaatacttctgtgataagcttacttggtgatacctctattcttgatgacctttttaaaagtcatgggaacagtcccacacaactgccaaagaaagttctttcagggcccatggaaaaagcaaaacagagaccaaaagatttctgggacatcttgaatgagcagaatgatgagagtcttagtaaactcacagacttggcagtaatagagactctgtgtgaaaaagcacctctagcagcaccctttaaaaggagagaagagccagcaacttctctttggaaatcaaatgagaaatttttatggaagaaatttagcccaagtgatacagatgaaaacgcaaccaatacacagagtaccacataa

SEQ ID NO: 2641 - DNA, 1395 bp, Homo sapiens
gagcagccggtcctccagtggctccgctccccgttctctgtgggctcaaaatgacagggcatactcggtccagcttaccacgttgtacaggaattgtcttgctgataaaattgcgtttctcggagaggctcacaggacacctgcatgcccaaggcactccaccgtatgtgatcaacctggatccagcagtacatgaagttccctttcctgccaatattgatattcgtgatactgtaaagtataaagaagtaatgaaacaatatggacttggacccaatggcggcatagtgacctcactcaatctctttgctaccagatttgatcaggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatcttatacaaaaccaagctgcctttcattgtggtcatgaataaaactgacatcattgaccacagctttgcagtggaatggatgcaggattttgaggctttccaagatgccttgaatcaagagactacatacgtcagtaacctgactcgttcaatgagcctggtgttagatgagttttacagctcactcagggtggtgggtgtctctgctgttctgggtactggattagatgaactctttgtgcaagttaccagtgctgccgaagaatatgaaagggagtatcgtcctgaatatgaacgtctgaaaaaatcactggccaacgcagagagccaacagcagagagaacaactggaacgccttcgaaaagatatgggttctgtagccttggatgcagggactgccaaagacagcttatctcctgtgctgcacccttctgatttgatcctgactcgaggaaccttggatgaagaggatgaggaagcagacagcgatactgatgacattgaccacagagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgata

SEQ ID NO: 2642 - DNA, 3080 bp, Homo sapiens
agaggtcagacatgccagcagggttggaaagaggcaggtacggaagctgagctgcagagttagccggcatctgacagaaaaatgtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagctcgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccgggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagtgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatctccctattcccttaccctgttactcagccacgccgtgtgtaggcttagcctcaggtggcagatgtttgaggaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagactaacttttcaagcaaatgcatctgtaaagatgctttagattagactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacgtctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttacatgtgtagtatttgaggaaaaaaatcaataaacagttgatctcgtg

SEQ ID NO: 2643 - DNA, 521 bp, Homo sapiens
agagcgatgagtgagaacgccgcaccaggtctgatctcagagcttctcctgcaaagaggaaccacgaaggtggccacaggtctggttctgaacagagaccagaggctcgcctgggcagagaacagcattgacttcatcagcagggagctgtgtgcgcattccatcaggaagctgcaggcccatgtcctgttgatcaaagcagtccacggatattttgattcaagacagaattactctgagaaggagtccctgtcgttcatgatagacacgatgaaatccaccctcaaagagcagttccagtttgtggaagtcccaggcaatcactgtgtccacatgagcgaaccccagcacgtggccagtatcatcagctccttcttacagtgcacacacatgctcccagcccagctgtagctctgggcctggaactatgaagacctagtgctcccagactcaacactgggactctgagttcctgagccccacaacaaggccagggatggtggggacaggcctcactagtc

SEQ ID NO: 2644 - DNA, 517 bp, Homo sapiens
gtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaa

SEQ ID NO: 2645 - DNA, 1407 bp, Homo sapiens
atgcacacatacgcgcgcgcacatgcacataggcacacagagatacgcgcacacacacacacaaacgcactcagatttcccggaccctggttttcctcctgtgaccctttcggggccgggctctcaccctaaagaagcagccccgccctggggtggccccaccctctcttgggacctgtcataagtcggaccccgggcgcccggctgcgcagtcccagccgccttccccaggcagtggaaccttcgggctcctgagcttcaggatggttcgtactaagacatggaccctgaagaagcactttgttggctatcctactaatagtgactttgagttgaagacagctgagctcccacccttaaaaaatggagaggtcctgcttgaagctttgttcctcaccgtggatccctacatgagagtggcagccaaaagattgaaggaaggtgatacaatgatggggcagcaagtggccaaagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccaggcctgactgcctactttggcctacttgaaatctgtggtgtgaagggtggagaaacagtgatggttaatgcagcagctggagctgtgggctcagtcgtggggcagattgcaaagctcaagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagggtaaaatccagtacaaggaatatatcattgaaggatttgaaaacatgccagctgcatttatgggaatgctgaaaggagataatttggggaagacaatagtgaaagcatgaaaaagaggacacatggaatctggaggccatttagatgattagttaatttgtttttcaccatttagcaaaaatgtatactaccttaaatgtcttaagaaatagtactcataatgagtttgagctacttaataaaatacatttaagtggtatgtaa

SEQ ID NO: 2646 - DNA, 2315 bp, Homo sapiens
gctgctgctccagatgaggtgatggcaacggccaacttcggcaagatccagatcgggatttacgtggagatcaagcgcagcgatggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttcaagagataatagagtggttggttcagcacgtgcacggcccagtcaatttcctgaacagtcttcctctgcacaacagaatggtagtgtttcagatatatctccagttcaagctgcaaaaaaggaatttggacccccttcacgtagaaaatctaattgtgtgaaagaagtagaaaaactgcaagaaaaacgagagaaaaggagattgcaacagcaagaacttagagaaaaaagagcccaggacgttgatgctacaaacccaaattatgaaattatgtgtatgatcagagactttagaggaagtttggattatagaccattaacaacagcagatcctattgatgaacataggatatgtgtgtgtgtaagaaaacgaccactcaataaaaaagaaactcaaatgaaagatcttgatgtaatcacaattcctagtaaagatgttgtgatggtacatgaaccaaaacaaaaagtagatttaacaaggtacctagaaaaccaaacatttcgttttgattatgcctttgatgactcagctcctaatgaaatggtttacaggtttactgctagaccactagtggaaactatatttgaaaggggaatggctacatgctttgcttatgggcagactggaagtggaaaaactcatactatgggtggtgacttttcaggaaagaaccaagattgttctaaaggaatttatgcattagcagctcgagatgtctttttaatgctaaagaagccaaactataagaagctagaacttcaagtatatgcaaccttctttgaaatttatagtggaaaggtgtttgacttgctaaacaggaaaacaaaattaagagttctagaagatggaaaacagcaggttcaagtggtgggattacaggaacgggaggtcaaatgtgttgaagatgtactgaaactcattgacataggcaacagttgcagaacatccggtcaaacatctgcaaatgcacattcatctcggagccatgcagtgtttcagattattcttagaaggaaaggaaaactacatggcaaattttctctcattgatttggctggaaatgaaagaggagctgatacttccagtgcggacaggcaaactaggcttgaaggtgctgaaattaataaaagccttttagcactcaaggagtgcatcagagccttaggtagaaataaacctcatactcctttccgtgcaagtaaactcactcaggtgttaagagattctttcataggtgaaaactctcgtacctgcatgattgccacaatctctccaggaatggcatcctgtgaaaatactcttaatacattaagatatgcaaatagagtaaaggagtttggaattagtccatcagacattcccttctcacagggtagtggcagtcgccctgatctctctccttcttatgaatatgacgacttttctccttcagttaccagggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgaagaagaagtctctccacagttgtttactttccacgaagctgtttcacaaatggtagaaatggaagaacaagttgtagaagatcacagggcagtgttccaggaatctattcggtggttagaagatgaaaaggccctcttagagatgactgaagaagtagattatgatgtcgattcatatgctacacaacttgaagctattcttgagcaaaaaatagacattttaactgaactgcgggataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttc

SEQ ID NO: 2647 - DNA, 2090 bp, Homo sapiens
actacccagactgcctctgcttcagccatcgaggactcgggcggaactaagctacaaatccttcttcaaaccacaccaaaaacctattgcaaacgtaaatgctgccccattggaaagaaaggaaggctgggaactaagaagctattggttggtgatccctggaccaatcggaggagccgtgatttggcgggagtcttgaccgccgccgggctcttggtacctcagcgcgagcgccaggcgtccggccgccgtggctatgttcgtgtccgatttccgcaaagagttctacgaggtggtccagagccagagggtccttctcttcgtggcctcggacgtggatgctctgtgtgcgtgcaagatccttcaggccttgttccagtgtgaccacgtgcaatatacgctggttccagtttctgggtggcaagaacttgaaactgcatttcttgagcataaagaacagtttcattattttattctcataaactgtggagctaatgtagacctattggatattcttcaacctgatgaagacactatattctttgtgtgtgacacccataggccagtcaatgtcgtcaatgtatacaacgatacccagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggagatagtggagcaaaccatgcggaggaggcagcggcgagagtgggaggcccggagaagagacatcctctttgactacgagcagtatgaatatcatgggacatcgtcagccatggtgatgtttgagctggcttggatgctgtccaaggacctgaatgacatgctgtggtgggccatcgttggactaacagaccagtgggtgcaagacaagatcactcaaatgaaatacgtgactgatgttggtgtcctgcagcgccacgtttcccgccacaaccaccggaacgaggatgaggagaacacactctccgtggactgcacacggatctcctttgagtatgacctccgcctggtgctctaccagcactggtccctccatgacagcctgtgcaacaccagctataccgcagccaggttcaagctgtggtctgtgcatggacagaagcggctccaggagttccttgcagacatgggtcttcccctgaagcaggtgaagcagaagttccaggccatggacatctccttgaaggagaatttgcgggaaatgattgaagagtctgcaaataaatttgggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggagtaacctggacaagctgtaccatggcctggaactcgccaagaagcagctgcgagccacccagcagaccattgccagctgcctttgcaccaacctcgtcatctcccaggggcctttcctgtactgctctctcatggagggcactccagatgtcatgctgttctctaggccggcatccctaagcctgctcagcaaacacctgctcaagtcctttgtgtgttcgacaaagaaccggcgctgcaaactgctgcccctggtgatggctgcccccctgagcatggagcatggcacagtgaccgtggtgggcatccccccagagaccgacagctcggacaggaagaacttttttgggagggcgtttgagaaggcagcggaaagcaccagctcccggatgctgcacaaccattttgacctctcagtaattgagctgaaagctgaggatcggagcaagtttctggacgcacttatttccctcctgtcctaggaatttgattcttccagaatgaccttcttatttatgtaactggctttcatttagattgtaagttatggacatgatttgagatgtagaagccattttttattaaataaaatgcttattttaggctccgtcccca

SEQ ID NO: 2648 - DNA, 902 bp, Homo sapiens
agaagaccgccccactctcgtcgcactagggaccccgaaatccgaccgcccatgggaagccactcgccagagtcttacctgaggggattccttaccccatcaccatgtgcacctcagaaactttccaagcgctggacaccttcgaagccagacatgatgacatcgtgctagcatcttatccaaagtgcggttcaaactggattctccacattgtcagtgaattaatatatgctgtttctaaaaaaaagtataaatatccagaattcccagttcttgaatgtggggattcagaaaaatatcagagaatgaaaggctttccatcaccaaggattttggcaactcacctccactatgacaaattacctgggtctatcttcgagaataaagccaagatattggtgatatttcgaaaccctaaagatacagcagtatcttttttgcatttccacaacgatgtccccgatattccaagctatggctcttgggatgaattcttcagacagttcatgaaaggacaagtttcttggggaaggtattttgattttgcaatcaattggaacaaacatcttgatggcgacaatgttaagttcatattatatgaagacctgaaagagaatctggctgctggaataaaacagattgctgagttcttgggattctttctaactggggagcaaattcaaactatctcagtccagagcaccttccaagccatgcgtgcgaagtctcaggacacacacggtgctgtcggcccattccttttccgcaaaggtgaagttggtgattggaaaaatttgttcagtgaaattcagaaccaggaaatggatgaaaaattcaaagagtgcttagcaggcacctccctcggagcaaagttgaagtatgaatcatattgccagggttga

SEQ ID NO: 2649 - DNA, 2808 bp, Homo sapiens
atgaatgaagctatggctacagattccccaagaagacccagtcgttgtactggtggagttgtggttcgcccccaggctgtcacagagcagtcctacatggaaagtgttgtgacttttctgcaggatgttgtgccacaggcttacagtggaacacctctaacagaagaaaaggagaaaatagtctgggtcagatttgaaaatgcagatttaaatgatacatcaagaaatctggaatttcatgaaatacatagtactgggaatgaaccgcctttgttgattatgattggctacagtgatggaatgcaggtctggagcatccctatcagtggtgaagcacaagagctcttctctgttcgacatggcccaattcgagcggctagaatcttgcctgctccacagtttggtgctcaaaaatgtgataactttgctgaaaaaagacccctccttggtgtttgtaagagcattggatcttctggcacaagcccaccgtactgttgtgtggatctgtattcacttcgtactggggagatggtcaagtccattcaatttaagacacctatttatgatctccattgcaataaacggatccttgtcgtagtcttgcaggagaaaattgctgcctttgatagctgtactttcacgaagaaattctttgttacaagctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccggcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagacacagcccttgacgtagcagtaaaaaccttcccccctgagagacacgtggcagtgaagtgttttgaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtag

SEQ ID NO: 2650 - DNA, 1226 bp, Homo sapiens
gggcccagcccgaggaggcactcagggttaggaggtctgggcgagaagcaactagggccctcatcacttcgccgccgaatccccggcgccgcccagcggggcagagccaggccagggccgcccgcccaacctggtccgctgcctcttcggccatggaagctgccggcagccctgcggctacggagacaggcaagtatatcgcgtcaacacagcgacctgacgggacctggcgcaagcagcggagggtgaaagaaggatatgtgccccaggaggaggtcccagtatatgaaaacaagtatgtgaagtttttcaagagtaaaccagagttgcccccagggctaagccctgaggccactgctcctgtcaccccatccaggcctgaaggtggtgaaccaggcctctccaagacagccaaacgtaacctgaagcgaaaggagaagaggcggcagcagcaagagaaaggagaggcagaggccttgagcaggactcttgataaggtgtccctggaagagacagcccaactccccagtgctccacagggctctcgggcagcccccacagctgcatctgaccagcctgactcagctgccaccactgagaaagccaagaagataaagaacctaaagaagaaactccggcaggtggaagagctgcagcagcggatccaggctggggaagtcagccagcctagcaaagagcagctagaaaagctagcaaggaggagggcgctagaagaggagttagaggacttggagttaggcctctgaggcctttggggaatagggaatggactgcagaacaaaccgtggggctctctggggtctgggggaatacgggcaacagcagtcaggaggggtaccccccatactggcttacttccacctcctgcggcccagctctgtcctccagagcctagcgtctccctcaatccttcccttttcttcccaacttctactttttggactttccccctcccattcccagtgttcaaaatctcagtgactaccccaggtacctttgctgctgatttgggtgtcttgtttaaaagaaaatcaggtgggtgggaatctcttggagaactgaggctgagggtagagggagtatgcccaagtcttggagtcttggttcctgttcgcggtgtttatgggttatttccctctccatccctcattttttttttttttttaaaaaaagcaaaaatgagaataaacacaagtagacatgtc

SEQ ID NO: 2651 - DNA, 847 bp, Homo sapiens
gcgggcgctgcggcccctgctctacctcctagcgccggtgcgcggccgaggccgcactacctgtctgcgggaaagcgggatccaccccaggacgtcgggtcgctgccgacataatgtcaagtggaaactatcagcagtcagaggctcttagcaaacccactttcagtgaggaacaagcctctgcgttagtggagtcagtgtttgggttgaaagtttccaaggtccggccacttcctagctatgatgaccaaaactttcatgtctacgtttcaaaaaccaaagatggcccaactgaatatgtcctcaaaataagcaacaccaaggctagcaaaaatccagacctgattgaagtgcagaatcacatcatcatgtttctgaaagccgctggatttccaacagcctctgtgtgtcacactaaaggagacaacacagcttctctcgtgtctgtagatagtggctctgaaatcaaaagctacttggtgaggctgctgacttacctcccaggaagacccatcgctgagcttcccgtcagcccccagctattgtatgaaattggaaaactagctgccaaattggataagacactgcagagattccatcacccaaagttaagtagtcttcatcgggagaacttcatctggaatctgaaaaatgttcctcttctggagaaatacctgtatgccctgggccagaatcgaaaccgagagattgttgagcatgtcattcatctgttcaaggaggaagtaatgaccaaattaagtcattttcgagaatgacctagcaccgtgccaggcccctagaagacccagtaaagatctgttgaataaactgtaagaatgaacacacc

SEQ ID NO: 2652 - DNA, 663 bp, Homo sapiens
atggtagctgtgtgcaaggggagagcagcagggtttagaattccaggaaggaagagagagtgatgtcatcagattccatggaccagcccaggaacccctgtgagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgcagacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggcc

SEQ ID NO: 2653 - DNA, 998 bp, Homo sapiens
cgcgctcttcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaatttctgtgctaaacagtgttacagtcgccaagagcccataaagggagccctcctggaagtggatgaggccttgggtctcggctcttcattgcttcctgagctgcagcagatgcctttacaaccaagctcaccgaggacgtctgtctcccatattaccctggcagagggccaggcctgttctacacggccggggtttcaacaaggtactgatgtcttctgcccttgcctcttcgacaggcaagtaataagacttaagtgaagagaattctttaggcacacaaattcacatttgatgtaatctcattatacttcctgatctgtgattgaaaactttcatttcgtaactagtatgtctgtcccacctttaaaaagtttttcattatgaaagtaagtatttgttagaattaagtctatttaaatgaaaaaaacttagatatgagtctgcatggcctcaggaaaatgatgttttaaaatagagattttaggttgtctgcactctagcttttttgtcgttttcttaaggcttttttaactgcatcaaaaattcagatacgaaacatacactaaaaaataatacatcatatcttaatttccactgaacttgatttaaattcagagt

SEQ ID NO: 2654 - DNA, 817 bp, Homo sapiens
ctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaagtcttcaaaacgatgatctcttcaaaacagattgtcaccatcagtgagaaaccgaacaagaagaggaaagcaaatggcattttcttctctacttggtgaaaagtcattatagaggattcgaacggttccaatgctcgcaattctacttcaagcatgtgctcattctacatatcaacccctttttcactgacaaatgtaatgttgacaatctaggctaatgggactagattttgaatccaatcaacactttttcatataaagttttcagaataacaaagctttccctcattcatacagatattgctgtactaatctataattatgttttagaattcaaattataacactgactaaacatcactaatgaaacatttgtgacctccttttttccgaagtttaatttttgctttgaattcatattttatcagtatgtgttaatataatgtca

SEQ ID NO: 2655 - DNA, 1845 bp, Homo sapiens
atctggctttgttttttctttacgtcacttagcgccagtttgttctggccgtgtctcccactagaatgagttaagcccagagtcaacacatccagatttccgaatgtggctaacgagttacccatctccaaatttccctgtgtcagtactgcagaatggagtgaaaatgaccaatgaagcaccaaaaggtttacgggctaatatcattcgatcatacctcatggacccgatctctgatccggagttctttggcagctgcaaaaagcctgaggaattcaagaaattgctttatggcctgtgtttctttcatgctttggtacaagaaagacggaaatttggacccctagggtggaatattccttatgagttcaatgagacagatctgagaatcagcgtacagcagctccacatgttcctgaaccagtatgaggaactgccgtatgaggctctgcggtacatgactggcgaatgcaattacggaggcagagtgaccgatgactgggaccggcgcacgctgcgcagcattctaaacaaattcttcaatcccgaattagttgaaaattcagactataagttcgactcaagtggcatctattttgttcctccttctggtgatcacaaaagctacatcgaatacacaaagactctgccactgaccccagcaccagaaatctttgggatgaatgccaatgcagatatcactaaggatcagtcagaaactcagctgctatttgataacattcttcttacacagtctcgttcagcaggtgctggtgcaaaatcatcagatgaagtagtgaatgaggtcgctagtgacatcttgggcaaacttccaaacaacttcgacatcgaggctgccatgaggaggtacccaacaacttatactcagagcatgaacactgtacttgtccaagagatgggacggttcaataagttactgaagaccataagagattcgtgcgtaaatattcaaaaagcaatcaaggggcttgcagtcatgtctacagatcttgaagaagtggttagcagcattttgaatgtcaaaattccagaaatgtggatgggtaaatcctacccaagccttaaaccacttggcagctatgtgaatgacttccttgcaagactaaaattcttgcagcaatggtatgaggttggtcctcctccagtcttctggctttctggcttcttcttcacacaagccttcctgaccggtgcccagcagaactacgccaggaaatacacaattcctattgatcttcttgggtttgactatgaagtgatggaagacaaagaatacaagcatcctcctgaggatggtgttttcattcacggattatttctggatggagcttcctggaatagaaagatcaagaaacttgcagaatcgcatcccaaaattctttatgatacagtgcctgtgatgtggctaaagccctgtaagagggcagatataccaaaacggccaagttatgttgctccattgtataagacaagtgagcggagaggagtattatccaccactggccattccacgaattttgtgattgccatgactcttccctctgaccaacccaaggaacactggattggacgaggtgtagcactgttatgtcaacttaattcataaccagaagacatcatttccttgttcctatttcttgttggctggctgagtagagaaagcatattttactacttaaacctttttttttgtttgtttaaatacatttgactaaagttataattatgaatttacttatgagcaaatgcagctaaacttaatatgactcatacttaaatgtaaggaaatgttctgaaataaagactaaagaaaacacactggca

SEQ ID NO: 2656 - DNA, 1783 bp, Homo sapiens
gcgctgcccggctcccggccctgccggcctcctcccttggcgccgcggccatggcggccagcgcgaagcggaagcaggaggagaagcacctgaagatgctgcgggacatgaccggcctcccgcacaaccgaaagtgcttcgactgcgaccagcgcggccccacctacgttaacatgacggtcggctccttcgtgtgtacctcctgctccggcagcctgcgaggattaaatccaccacacagggtgaaatctatctccatgacaacattcacacaacaggaaattgaattcttacaaaaacatggaaatgaagtctgtaaacagatttggctaggattatttgatgatagatcttcagcaattccagacttcagggatccacaaaaagtgaaagagtttctacaagaaaagtatgaaaagaaaagatggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcagctcagaattctgcaaatgcagattttgcaaactttgatgcatttggacagtctagtggttcgagtaattttggaggtttccccacagcaagtcactctccttttcagccccaaactacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggagctacgccttccacaaatccatttgttgctgctgctggtccttctgtggcatcttctacaaacccatttcagaccaatgccagaggagcaacagcggcaacctttggcactgcatccatgagcatgcccacaggattcggcactcctgctccctacagtcttcccaccagctttagtggcagctttcagcagcctgcctttccagcccaagcagctttccctcaacagacagctttttctcaacagcccaatggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacat

SEQ ID NO: 2657 - DNA, 2572 bp, Homo sapiens
ggtgccccccgggcgcaggccagggaggcccgagcgccttccccacgccccgctcgcccgcgcgtgtgaggggagggcggcccagccgtttcgcgccgggagattttgtggaagtataatactttgtcattatgagatgtcgtctctcggtgcctcctttgtgcaaattaaatttgatgacttgcagttttttgaaaactgcggtggaggaagttttgggagtgtttatcgagccaaatggatatcacaggacaaggaggtggctgtaaagaagctcctcaaaatagagaaagaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgctgctgccttcctttgagattggtgcatggacggaagacgatgtgtattgttgggttcagcagctcgtcagaaaaggtgactcttcagcagagatgagtgtatatgcaagcttgtttaaagaaaacaacattacagggaagcggctgctgctgctggaggaagaagacctgaaagacatgggcattgtctccaaggggcatatcattcacttcaagtcagccattgagaaattaacccatgattacataaatttgtttcacttcccaccactaattaaggactcaggaggtgaacctgaagaaaatgaggaaaaaatagtgaacctggaactggtttttggttttcacttgaaaccaggaactggcccacaggattgtaagtggaaaatgtatatggagatggatggggatgaaattgcaataacctacataaaagatgtgacattcaacactaacctacctgatgcggagattttaaagatgacaaagccaccatttgtaatggagaagtggattgtaggaatagcaaaaagtcagactgtggagtgcactgtcacatatgagagtgatgttagaactccaaaaagcactaaacatgtccattcgattcagtggagtagaacaaaacctcaggatgaagtgaaagcagtccaacttgccattcagacattattcaccaattcagatggcaaccctggaagcaggtccgactcaagtgctgattgccagtggttagatactctgaggatgcggcagattgcatccaacacttctttacagcgttcccagagcaatcctattctggggtcaccgttcttctcacactttgatggccaggattcctacgctgctgctgtgagacggccccaggtgcccattaagtatcaacagattacacctgtgaaccagtccagaagctcgtctcctactcagtatggactgaccaaaaacttctcttccctacatctcaactctagggacagtggcttttccagtggcaatactgacacctcttcagagaggggtcgatactcagacagaagcaggaacaaatatggacgtggtagtatatcactcaattcttctcctagaggaagatacagtggaaagagtcagcattccactccttcaagaggaagataccctggaaagttctacagggtttctcagtcagcactcaatcctcaccagtcgcctgacttcaagagaagccccagggacctccaccaacccaacaccataccagggatgcctttgcaccctgagactgactcaagagccagtgaagaggacagcaaagtcagcgaagggggctggacaaaagtggaataccggaaaaagccccacaggccatctcccgccaaaaccaataaagagagagccagaggggaccaccgtggatggagaaacttttgatgaattgaactacatagcttttctaagcaggtt

SEQ ID NO: 2658 - DNA, 689 bp, Homo sapiens
gcggcggcgcctgacgagggtgccgcggccgctgggcgcagcgttcgggggttgcacggcccgcggcggcgacgaaaacaacgaccaggacgctcggcgcccctgtccgcagagtcgccactcccgcctcttctccggtctctagcgacgcgggcccgcggcttcctcctttcctgcccagttcccgcgggcctcggggttgcagcggctagaagtgccgaggagcgccaggaggacccggccggctgcgaggattcacgcgcccgccaccccgcccggcccgggcttcatgtgaaagagggacgggcctggccccaaggcccgcgcccgactcctcgcgcgcccctccggtccccgggggccctgcggcagcccccgacctggggccgcggtgacaggccgcgctggggcggaggggcgggctcggcgggggcggcccctccttgggcctgcggctctctacgtccctgcggagcagccggccataaagaatgctgatgggagaaccattttcctaattttcaaattgttgagctgtttgccataatggatgatcagcaagctttgaactcaatcatgcaagatttggctgtccttcataaggccagtcgaccagcattatccttgcaggaaaccagaaaagcaaaatcttcatcaccaaaaaaacagaatgatgtccgagtcaaatt

SEQ ID NO: 2659 - DNA, 2455 bp, Homo sapiens
cgggtggggaggtggggtccgggtgtgcgccgcggcgctggctgcgaaggcagtggccgaggcgggctccctctgggccgtgcccggcctggctaacaaagccgccgcggcctctgttgtgtgatggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgttttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactg

SEQ ID NO: 2660 - DNA, 1441 bp, Homo sapiens
ctctttctctctcacagcttctcacgaggtagaactttagagcctggtgtgtttgtggctggagcatagcagctcttctacaactttactgtagtttctactgaatattttggtttgcaaatataaaggattctctgaagcacaaccttaaataacgtgtggtagacacctgggagaggaaaactgcagacagaaaaatgtggccggatgctctgtgggcgggcggcagcgatgttcggccaggtggctccaaggagaggaagcagtgatgcattgaggtaaaaataagtgactaaagaagcagacctgggaatcacctaacatgtcgaggaggagatttgattgccgaagtatttcaggcctactaactacaactcctcaaattccaataaaaatggaaaactttaataatttctatatacttacatctaaagagctagggagaggaaaatttgctgtggttagacaatgtatatcaaaatctactggccaagaatatgctgcaaaatttctaaaaaagagaagaagaggacaggattgtcgagcagaaattttacacgagattgctgtgcttgaattggcaaagtcttgtccccgtgttattaatcttcatgaggtctatgaaaatacaagtgaaatcattttgatattggaatatgctgcaggtggagaaattttcagcctgtgtttacctgagttggctgaaatggtttctgaaaatgatgttatcagactcattaaacaaatacttgaaggagtttattatctacatcagaataacattgtacaccttgatttaaagccacagaatatattactgagcagcatataccctctcggggacattaaaatagtagattttggaatgtctcgaaaaatagggcatgcgtgtgaacttcgggaaatcatgggaacaccagaatatttagctccagaaatcctgaactatgatcccattaccacagcaacagatatgtggaatattggtataatagcatatatgttgttaactcacacatcaccatttgtgggagaagataatcaagaaacatacctcaatatttctcaagttaatgtagattattcggaagaaactttttcatcagtttcacagctggccacagactttattcagagccttttagtaaaaaatccagagaaaagaccaacagcagagatatgcctttctcattcttggctacagcagtgggactttgaaaacttgtttcaccctgaagaaacttccagttcctctcaaactcaggatcattctgtaaggtcctctgaagacaagacttctaaatcctcctgtaatggaacctgtggtgatagagaagacaaagagaatatcccagaggatagcagcatggtttccaaaagatttcgtttcgatgactcattacccaatccccatgaacttgtttcagatttgctctgttag

SEQ ID NO: 2661 - DNA, 1730 bp, Homo sapiens
cggggctctggccatataaacagagggacgcacgcccatgcggctgtagacgccatgatggatgtgtctggtgtgggtttcccaagcaaggttccttggaagaagatgtctgcagaggagctggagaatcagtactgtcccagccgatgggttgtccgactgggagcagaggaagccttgaggacctactcacagataggaattgaagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaagtaaggatgagtctgccttcatggtccacccgctgacggcacagggagtggccgtggtaatagtggcttacggcatcgcccccaaaggcaccctggaccacatggtagaccaggtgacccgcagcgttgcgtttgtccagaagcggtatccaagcaacaagggaatttacctgtgtggacactcagccggggcccacctggctgccatgatgctcctggccgactggaccaagcatggggtcacgcccaacctcagaggctttttcctggtgagtggggtctttgacctggagcccatcgtgtatacttcacagaacgttgctctccagctgaccctggaggacgctcagaggaatagcccccagctgaaggtggcccaggcacagccggtggaccccacctgccgtgtgctggtggtcgtgggccagttcgactcccccgaattccaccgacagtcctgggagttttaccagaccctgtgtcaaggagagtggaaagcctcatttgaagagctccacgatgtggaccactttgaaattgttgagaatctgacccagaaggacaacgtgctcacccagattatcttgaaaacaatcttccagtagttctgacgatacttggagcctggtccacgtgcatcccaccttgggaagcctctccaaagagctttcggagctgacactgacagcttcagtttcccccagcacccaggagagccttgctgtgtctgtctgcccggcaagagtccattctcactgctgggacactcatgaaaatctccacgtcctccctcttcccagcctggatggagctccagggctggggaacgtccgcaagtcaatgctcagagatgcccggagctgcctcttagactcgtctggcccatctacctgctgacagagcatgacaaagatgacgctcaaaagtaatgccattacttcttttttttttttttttttttttttttttgagatggagtcttactctgtcacccaggctggagtgcagtggcgtgatcttggctcactgcaacctccacctcccgggttcaagcaattctcctgcctcagcctcctgagcagctgggactacaggcgcctgccatcatgcctggctaatttttgtatttttagtagagacggggtttcaacatattggccaggctggtctcaaactcctaaccttgtgattcgcccgccttggcctcccaaagtgctgggattccaggcgtgagccactgcgcccggccagaatggcattatatttaaatagttcataaagaagcacaaaagaatattatttcataacatgtaaaaattatataaaacgtaaatttccatgttgataaataaagttgtattggaacacg

SEQ ID NO: 2662 - DNA, 1045 bp, Homo sapiens
tttctccctgtttgctggcccagacaggcctgtgctagagggctggatagtgtggtagtgtggtggatagagtgctgcctctatccacaacgcagccatatgctgactgaagataactttgtgtctggaagagccctctgatttcttacactaatggccttacacgacatggaggattttacatttgatggaacaaagcgcttaagtgtcaactacgtgaagggaattcttcaaccgacagacacctgtgacatctgggataagatctggaacttccaagccaagcctgatgacctgcttatttctacctatcctaaagcaggaacaacatggactcaggagatagtggaattaatacaaaatgaaggtgatgtggagaaaagtaaacgggcaccgactcatcaacgatttcctttcctcgaaatgaaaatcccatccttaggatctgtgtgctggggctcctggcatgaacatgtgaaaggatggtgggaagccaaagacaaacaccgtattctctatctcttctatgaggacatgaagaagaacccaaagcatgaaattcagaagctggcagaatttattgggaagaaattagatgacaaagttctagataaaattgtccattacacttcgtttgatgtcatgaaacagaatccaatggcaaactattcatcgattcctgctgaaatcatggaccactccatttctccattcatgagaaaaggggcagtgggagactggaagaaacacttcaccgtggctcagaatgagagatttgatgaagattacaagaagaaaatgactgataccagactaactttccacttccagttctagtaaggaagaaaaactgaaaatgttttagtttattacccagtatatttgggtaataatgaaagtttaattctcataacaaatgatatcagattccagttatcagaatagtttactgtgtttgctcttattcactctactaaaaaattattttaaaaggctggaggcaaggtggtgacaggcagcagggtggcgacatggagagagggaa

SEQ ID NO: 2663 - DNA, 716 bp, Homo sapiens
ctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaagtaagttctccatcccataaagccatttaaattcattagaaaaatgtccttacctcttaaaatgtgaattcatctgttaagctaggggtgacacacgtcattgtaccctttttaaattgttggtgtgggaagatgctaaagaatgcaaaactgatccatatctgggatgtaaaaaggttgtggaaaatagaatgcccagacccgtctacaaaaggtttttagagttgaaatatgaaatgtgatgtgggtatggaaattgactgttacttcctttacagatctacagacagtcaatgtggatgagaactaatcgctgatcgtcagatcaaataaagttataaaattgc

SEQ ID NO: 2664 - DNA, 572 bp, Homo sapiens
ctttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaagctacaccaaaattgcattgagccaaacttgccaccaagagcccaacaatcaccatgatgctgagcacggaaggcagggaggggttcgtggtgaaggtcaggggcctaccctggtcctgctcagccgatgaagtgatgcgcttcttctctgattgcaagatccaaaatggcacatcaggtattcgtttcatctacaccagagaaggcagaccaagtggtgaagcatttgttgaacttgaatctgaagaggaagtgaaattggctttgaagaaggacagagaaaccatgggacacagatacgttgaagtattcaagtctaacagtgttgaaatggattgggtgttgaagcatacaggtccgaat

SEQ ID NO: 2665 - DNA, 1447 bp, Homo sapiens
acttttcttgtcgggcaactaggtgccgagcagtgctgcgcccggaagctggccgccactgcggggaggttgggccgaggcggcaggcgggcgggctggggcactggtgcccggcctgctcttccggagctgcagcccctcaatttggctgaggcggtggcggccgccgtgaggcctgcggagctccgacccaggggatttctataattggcctgatgaatcctttgatgaaatggacagtacactagctgttcaacagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggtaaaattgctgctaaacaatcattggatcacaatcctcatcagacaaacccatctgtaaaaaaaatgagggagagcttgaggtttcacacaagccatttactaaagaggtagaaatgttttctattggttttaccttgagtttagatatcctaaaaaattctgtagtacgtagttttgtcttacctgttaactttccccaattgagataaaagtgttttaaaattctgtttatagtttttgatatgcatatataattatgtgtatatctaaatacaaatgcaaatgaagcattagtaatacttaaataattttactgtgctacataaagtataacatacttggaaaggatttaccgttctgcaacaacgga

SEQ ID NO: 2666 - DNA, 4502 bp, Homo sapiens
gggaagtccggatcccgcggcgatccgagcatgagcctggagcgcgagcttcgccagctgagcaaggcgaaagccaaggcgcagagggccgggcagcggcgcgaagaggccgcgctgtgccaccagctgggggagctcctggccggccatggccgctacgccgaggctctggagcagcactggcaggagctgcagcttcgggagcgcgctgacgaccctctgggctgtgccgtggcccaccgcaagatcggagagcgcctggccgagatggaggactacccggctgccttgcagcaccagcaccagtacctggagctggcacattccctgcgcaaccacacggagctgcagagggcctgggccaccatcggccgcacccacctggacatctatgaccactgccagtcgagggatgctttgctgcaggcacaggctgcctttgagaagagcttggctattgtggatgaggagctggaggggacactggcccagggagagctgaatgagatgaggacccgcctctatctcaacctgggcctcacctttgagagcctgcagcagacagccctgtgcaacgattacttcaggaagagcatcttccttgcggagcagaaccacctttacgaggacctattccgcgcccgctacaacctgggcaccatccactggcgcgcgggccagcactcccaggctatgcgctgcttggagggtgcccgggagtgtgcgcacaccatgaggaagcggttcatggagagcgagtgctgcgtggttattgcacaggtcctccaagacctgggagactttttggctgccaagcgagccctgaagaaggcctacaggctgggctcccagaagcctgtgcagagggcagccatctgtcagaacctccagcatgtgctggcagtggtccggctgcagcaacagctggaagaggctgagggcagagaccctcagggtgccatggtcatctgtgagcagctaggggacctcttctccaaggcaggagactttcccagggcagctgaggcttaccagaagcagctgcgttttgctgagctgctggacagaccgggtgctgagcgggccatcatccacgtgtccctggccaccacactgggagacatgaaggaccaccatggggccgtgcgccactatgaggaggaactgaggctgcgcagcggcaacgtgctggaggaggccaagacctggctgaacattgcactgtcccgcgaggaggccggcgatgcctacgagctgctggccccgtgcttccagaaagcgctcagctgtgcccagcaggcccagcgtccccagctgcagaggcaggtcttgcagcatctccataccgtgcagctgaggctgcagccccaggaggcccctgagaccgaaaccagactacgggagctcagtgtagctgaagatgaagatgaggaggaggaggcggaggaggcggcagccacagcggagagcgaagccctggaggccggcgaggtggagctctcagagggcgaggacgacaccgatggcctgaccccgcagctggaggaggacgaggagcttcagggccacctgggccggcggaaggggagcaagtggaaccggcgaaacgacatgggggagaccctgctgcaccgagcctgcatcgagggccagctgcgccgcgtccaggaccttgtgaggcagggccacccccttaaccctcgggactactgtggctggacacctctgcacgaggcctgcaactacgggcatctagaaattgtccgcttcctgctggaccacggggccgcagtggacgacccaggtggccagggctgcgaaggcatcacccccctccacgatgccctcaactgtggccacttcgaggtggctgagctgctgcttgaacggggggcgtccgtcaccctccgcactcgaaagggcctcagcccgctggagacgctgcagcagtgggtgaagctgtaccgcagggacctggacctggagacgcggcagaaggccagggccatggagatgctgctccaggcggctgcctcgggccaagatccccacagctcccaggccttccacaccccaagcagccttctgtttgaccccgagacctctcctcctttgagcccctgcccagaacccccctctaatagcactagactcccagaggcctctcaggcccatgtcagggtctccccagggcaggcggcaccagccatggccaggcctcggaggagcaggcatgggccagccagcagcagcagcagctcagaaggcgaggacagcgcaggccccgcacggccgtcccagaagaggcctcggtgctcggccacagcacaacgggtggcagcctggacgcctggccccgccagcaacagggaagcagccacagccagcaccagccgggcagcctaccaggcagccatccggggtgtgggcagtgctcagagccggctggggcctggcccaccgcggggccacagcaaagcccttgccccccaggcagcgctcatcccggaggaggagtgcctggccggggactggctggagctggacatgcccctgacccgcagccgccggccccgcccccggggcactggagacaaccgcaggcccagtagtacctctgggtcggacagtgaggagagcaggccccgtgcccgagccaagcaggtccgcctgacctgcatgcagagttgcagtgcgccagttaacgcagggcccagcagcctggcttcagaacctccagggagccccagcacccccagggtctcagagcccagtggggacagctctgcggcaggccagcccttgggtccggccccgccccctcccatccgggttcgagttcaagttcaggatcatctcttcctcatccctgtcccacacagcagtgacacccactctgtggcctggctggccgagcaggcggcccagcgctactaccagacctgcgggctgctgcccaggctcaccctacggaaagagggggccctgctggccccacaggacctcatccctgatgtgctgcagagcaatgacgaggtgttggctgaggtgacttcgtgggacctgcccccgttgactgaccgctaccgcagggcctgccagagcctggggcaaggggagcaccaacaggtgctgcaggccgtggagctccagggcttgggcctctcgttcagcgcctgctccctggccctggaccaggcccagcttacacccctgctgcgggccctcaagctgcacacagcactccgggagctgcgcctggcagggaaccggctgggggacaagtgtgtggctgagctggtggctgccctgggcaccatgcccagcctggccctccttgacctctcctccaatcacctgggtcccgaaggcctgcgccagcttgccatggggctcccaggccaagccaccttgcagagtttggaggagctggacttaagcatgaaccccctgggggacggctgtggccagtccctggcctccctcctgcacgcctgccccttactcagcaccctgcgcctgcaggcgtgtggcttcggccccagcttctttctgagccaccagacagcactgggtagtgctttccaagatgctgagcacctgaagaccctgtccctgtcctacaacgccctgggagcccctgccctggccaggaccctgcagagcctgcccgccggcaccctcctgcacttagagctcagctccgtggcagccggcaagggtgattcggacctcatggagcctgtattccgatacctggccaaggaaggctgtgctctagcccacctgaccctgtctgcaaaccacctgggggacaaggctgttagagacctgtgcagatgtctctctctgtgcccctcactcatctcactggatctgtctgccaaccctgagatcagctgtgccagcttggaagagctcctgtccaccctccaaaagcggccccaaggccttagcttccttggcctgtcaggctgcgccgtccagggtcccctgggcctgggcctgtgggacaagatagccgcgcagctccgggaactgcagctgtgcagcagacgcctctgcgctgaggacagggacgccctgcgccagctgcagcccagtcggccgggccccggcgagtgcacgctggaccacggctccaagctcttctttcggcgcctctgaccctggcgctgcctttccccaccctcaccgaagcccctaataaatgaagctgctggccgggcgcggtggctcacgcctgtaatcccaacactttgggaggcccaggcgggcggatcacgaggtcaggagatcgagaccatcctggctaacatggtgaaaccccgtctctactaaaaataccaaaaattagccgggcgtggtggtggaagcctgtagtcccagctactccggaggctgaggcaggagaatggcgtgaacccgggaggcggagcttgcagtgagccgagatcgcaccactgcactccagcctgggcgacagaccgagactccgtctc

SEQ ID NO: 2667 - DNA, 2165 bp, Homo sapiens
ggcgctcggagcgggctccgcggcttgcaaggcgcctgcgactcggtcccaggtcggcgggcggcgcacggcgggctcgcgcgggggccccggcgcgccgggcggcgcagtacgcagcgcgcggacccacgccacggccaggagcccagagcagcgcggccacactgcccaggggtcggccctcggccccggcgctcggagcgcggcggctgcctgggctttaatggctgctccgcggagcagcgcctagggctggaaggcggctgcggctcaggaagtcacccgagcaagcctccttcggggccggccgcacccgccgcggcgcgctccatgggggcgcgctccccccgggcggcccgctgacccgggacgccggggcccgctcgctcgccggccgcgcgtcccggccatgaactgagcccgcgggccagccccgcgcctgctccgcccgcgcctttcttctcgcgcctcctccgcccgccgccggcgggcccggctccccgggggctgcggcgccccgggctcggcggcccgcgggccccggggcgcggggcggcggcggcggggggcgcgcggctccgggcgcggcgcctgcaccatgaactaccagcagcagctggccaactcggctgccatccgggccgagatccagcgcttcgagtcggtccaccccaacatctactccatctacgagctgctggagcgcgtggaggagccggtgctgcagaaccagatccgggagcacgtcatcgccatcgaagatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcctgcccttctttgtccttgcactgacagccagcacttatctcaggcctgctggagcccgtgcccgtcagtcctccccctggccagggccgaggggtggtcagaccagcccgcattgtgctgaaggcccacaatcagcccagctgtccggggccatgatgaattagcggtgggagttaacatagaggtgaactccagatcggccgatagcttgcaggccgctgctgtttgtcctgacttcagcgcatctctgatagacctttgacaccttccaacaaagaggttacaggagggagagctggagaaatggagcgctcctccagaaagttcggcaactcacaaaagaccccttaatttctatagcgggcaattcagtccacaaaggaaggaaatcaatgagcgtttacgctctttctttgaggaacctttttttaaagaaaaaaacatttactggcgctttgcatgttttgggtacaagcagtggtagaaacataaaacattaaaatccaagattga

SEQ ID NO: 2668 - DNA, 1732 bp, Homo sapiens
attaaacaatatctggtctcggtggctctgtcattccactgcaggcgtcccaccttcatttgccagctgggatctcttaatgagctagctgtgcacagttcaatagtaaaacccttttagctggtgaaatatgtttgaagaactcactgttggagtgttccatgtgaggcctgcttccactcttgctggcattctcttttcaggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcagtgtaacatgtatcccgttgcctgttgttcggttgtgtgactaattgtggattttaagctgctattattgtatttcagtggc

SEQ ID NO: 2669 - DNA, 888 bp, Homo sapiens
ccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaagggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatg

SEQ ID NO: 2670 - DNA, 4813 bp, Homo sapiens
agactaccggcggcgacgaccacaggagcatggcggacaccgacctgttcatggaatgtgaggaggaggagttggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgagggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatg

SEQ ID NO: 2671 - DNA, 1576 bp, Homo sapiens
acattttcaaggaattcttgagaggttcttggagagattctgggagccaaacactccattgggatcctagctggaatataaagaatggcttatcagtggagaccatcgacagttgagaaaagaagaagcccaaaaagtacaagaatgaaaatcgagagtttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcattagtgggatggtttggccatgaactcagcaccagatttaagatggataacaaactgcagttaatccctggggtctgtggattccgaatttcaaatcctcccattttgttggtctgttccttgcatgctagtttagagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattag

SEQ ID NO: 2672 - DNA, 6138 bp, Homo sapiens
gcgcgtttccattttaaaccgccgcccgccgcccgccacccgccacccttcggccgcagccggtgcagctgtccgcgcgtcccggagcccagggagtggcggaggctgcggaaccgccgagctgtgcagccggagcgggaggatgcgcacgggccccgcgtcgtagacaatgaagccgcgggcgccgccgcctgccctgggccctgcgcaccgcggccgcacctgccggcgagagcgctctagcgcctgaccggccgcctcgcttggccccgccggcccatggctcggcgccccgggcccggaccccggcactcgggcggcgcggcgcacgggccggcgggtgccaggggcgccgtccccgcagcctgagtgcggccctcgcggtcagcggggggcgtgggccacactcccggcccgcctgccctccccgcttggcccggcgccctcccggcccgcgggctcgctggatgcggcggggccccagcgcgcgggcgacatgtacttgttggacggcagtggcgagcccgcgtcgccacccgcggacgcgatgccgcgcgggacgccccccagaaagactgtctaccgcatctccgtgaccatggtcaggaaggagcagctggccgcgccgggctccggcggcccggacccacgcccggttcggcggccccggcccgcgcgctccccggacgcgcccgggaggcttgaggaggaggccgaggaggcggagggcgccgaggaaccggagggtccccggccgcgcgcttgggatttccgcaccttccgcacccgcagcaccgggcagctggaactggggcggctccggccgtgcgcacgcggcctggaacccgcggacctggccggcagcgccccggccgaggaggagggacgcggctcgcccgcgtccggcagccccgacgtggagggggcccgggccgcgcccctgcggcggagcctgagcttcaggcactggagcgggcctgaggcgccgcaaggccggacactgggcggcggaaggcgccacagcagctccgggagcctggcctgggcgccgtgcgacgaggccgcggccgggaccaccctggagcccgcgaccgccacgcagcccgcctcggagaagcgcaacaccctggacgtgggcgaggtgctcagcaagaacgacgcgctctcggacctggagcgttgggaacgcagtaagagcaagaaccgcacgctggacaacagcgacctgcagcggctggagcgcgcgcgggcggcggccggggccggcgcggcctcggagcaccggctgctgcgcttcttcagcggcatcttcgcgcgcagggacgggggcccgggcggcgggccctcgccacggagcggagcctcgcggccacgcggctacttcagcctgcggcgggccccggccgaagcgcactcgtccagcgccgagagcatcgacggctccccgcgcagagatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcatgctgttgaagcgaagtggcaaatcgttgaataaagagtggaaaaagaaatatgtcaccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggacgaggtgaacgagacctgcggggagggagacggccgcacggcgctgcatctggcctgccgcaaggggaatgtggtcctggcgcagctcctgatctggtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcacgtgagtcccgtcgcatcccctccctcttcctggtggccacctccctcccgcccacccactctcaccccaaacaaaatcacaaaacctggacatccctcaaggggcgaagaggcggccgggagactgcagaagtggctccttttcataaactcccctaaaccacacacaggagagagcgacgggcctcggccctttgatgatagcacatggcgcaggacccttgtcctggtggcacaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactggcttcattacacttgtacagccgagttcttcccgcattactgctgtttaatagaacgtgattagtcatcgccgagaagaaagcatattagccgaggaggtagtcacgcggcacgcgccggtgattgccacgatgtgattgcaatactcttagaagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaaaataaataagaataactcagaaactcaaaaggaaaccacaaattcagctaataatagcatttcgagtatatttcgtaaactaaggaaatacacaaaaggctgttttttccgactgtaagagatatttgatgtccttttgccgaggtggatgtgttagtctcaggccctcctggaccacgttgcccaagtcacacaggcttctgtgttatgtatttagataagatgtgtgaaaatatatttgaataaaagaagttcataaatatgcattgatttttgtacagacaaatggcacctctcttaatttataaattgaactggatgtgaactaataatgtgcaactagttgagataagagggttacagatcattgtacatggaaaatattcccagcagtaaacacttccattaatgtgatctacggcttttgaaaaggagcatctcagaataagatggtggtacaatttgcttattaaaattgagaaagaaaaaaaaagacacactggagtatattagaaaggaaaaagaaggaatgtggtctctcatgattgaaagcatgatttagatcggatacggcttttgctaaccaaggaccaagggactctggcaagatggggtggttttccgaatgccagaccgaggtgccttacgaaggcagctgccaatggttctgtggcacagactggctcctgagaacccagacgaccttgacctggcagcccggccctccacgctagtacctcgcctgattttccatcgttgcggtatccagccgcttcagacgtccgccgccttcagtggtggtagtcaaatgtagtcaaccaaaccacagcatcccttaggttaaaagcaaacggggcagctttgcctagagctcattgacagtgtgatggggggagaagggttgtcacaatggaagatgaggacactagactcatgtagcacagaaacatgaagccacacgcaccggcagcctccggggtgttcctcgctctctcgtatgttaaaccttatattttataagagtttttcctcttatttcactttttaaaaaaaattaaagtaggtggggaaaaaaataaagctttacacagaatttatatgtgggtaagtgtttcatggaaatttctaatcttaacgaagctaagtggagctcactcgtatccaaaagtataacaggtgcagaagccacaagtctgagaaccttgacgacagttccatcgtcctgccatttgatttttcagtctgcgtttcatcactgtgtagctattgtaaatgtgaatagaaaaaaacaggtcattgcctatttttgaagaacgcgttggtgttcgagtccactagacacactcgctccacacagccttcaccgtagactctgtagtggacacagatatagcataaatgaaattgttaaattatttcattgtagttaattcccactataggaatgctttatcatagtgaagtttcttttgagaagaaacggaactccttgaggcttctctttgggatgtatatgagcgtgtacatattattctatgtgtttataatataatattttcccaaa

SEQ ID NO: 2673 - DNA, 3383 bp, Homo sapiens
gacttccggtgctggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccagtaagggaataaagaagactggaaacgtctctcccctcccctatcccagtccctcaccctaatccgcgcgcaatagaaaaggcggaagcgcctgtccacgatcagggcggggcaaggggaagaaatctcgcgataggagagcggtccgggcgggggtggcacctctccctcctcctggcgttagttccggtcgcagaggagacaccgccgcagttgccggtacatcggggatttctggctctttcctcttcgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgttttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacacttaggctttata

SEQ ID NO: 2674 - DNA, 2901 bp, Homo sapiens
tgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaa

SEQ ID NO: 2675 - DNA, 770 bp, Homo sapiens
ctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaattgtcaccatcagtgagaaaccgaacaagaagaggaaagcaaatggcattttcttctctacttggtgaaaagtcattatagaggattcgaacggttccaatgctcgcaattctacttcaagcatgtgctcattctacatatcaacccctttttcactgacaaatgtaatgttgacaatctaggctaatgggactagattttgaatccaatcaacactttttcatataaagttttcagaataacaaagctttccctcattcatacagatattgctgtactaatctataattatgttttagaattcaaattataacactgactaaacatcactaatgaaacatttgtgacctccttttttccgaagtttaatttttgctttgaattcatattttatcagtat

SEQ ID NO: 2676 - DNA, 1058 bp, Homo sapiens
tcgcggcggtggctttgtgccacttttcccagggcttgggcatcattctggacccatgttcggtgaaccggttactctcagagctgctttcgggcgcagctcctgctgcagccagggcccgttttaagagaggcttccaggtccagccctcccgctgcagcctgcagggagcgagccggcctgtcccgatgacatagacactaggtttttacagcaattctctgatgaccttgatatggtagaacgctgtgtatttcaagagtaagctctcgtttgaggagactaacaattcctgttttcgccagtgccacctgtgatatatgtgaagttcctgaaatacctaagtccaagttacagctctgtcatattctactgattatttgttcctgtacctgtacaagatttcttcttgaatggcaacctaaatgccagtccaaagaggcccccaatagacttgttcacccttcatgtcctcaactctggggaagttaagtaatcaagttgaagaaacacttccactacttaaaaaggtacctgcaaattactttcacatttgttcagctatcctaatgggattttcacttagtaaatctgctactcaggtatctgctatacatatggattcaaaagtggatgatcacttaatacgagggactgaaaaaagcaggttggaaccagcgactcagttatttcaaaacaccaagaaaataagattagaagacacaaatcaagaaaactttacaaggattgaagggactggcacaggatctctttctgggaaagccttgggttcagtggtatatgtcaaagaaagtgatggactagaaatgacagatgtggaatgaagcaatttgtacgtattaccaaagaaaccaaaaactgcctttgactaaggggggtgttgaaagagaacttaaccttattaggaaaccctgacaaaatgatggaagactattgccttattttgcactatttgtgaatcatcttacactgcatttttttatgatgcttattcaaaaggcagttgctttagggtgaaaaagccttccaagattcaa

SEQ ID NO: 2677 - DNA, 1500 bp, Homo sapiens
atgtctactccttctggaatatccacctggctcagcctgcctgtttcgactcctgcctccatcacatccatcagagtgacccagaagtcctctggcccctgggccttcagcagctgcacctacgtgagtgggcctggcgtctgcatcagctccttgagctgctcccgagtggggagcagcagctttcggggtggcctgggtggaggctatggtggggccagtggcatgggaggcatcatcgccatcatggtcaaccagagcctgttgagcccccttaacctggaggtggaccccaacatccaggccgtgtgtacccaggagaaggagcagatcaagaccctcaacaacaagtttgcctccttcatcgacaaggtatggttcctggagcagcagaacaaggtgctggagaccaagtggagcctcctgcagcagcagaagatggctcggagtaacatggacaacatgttggagagctacatcaacaaccttaggcggcagctggagactctgggccaggagaagctgaagctggaagcagagcttggcaacatgcaggggctgggggaggacttcaagaacaagtatgaggatgagatcaataagcatacggaggtggagaatgaatttgtcctcatcaagaaggatgttgatgaagcttacatgaacaaggcagaactggagtccctcctggaagggctgactgacgagatcaacttcctcaggcagctgtatgaagaggagatccgggagctgcagtcccagatctccgacatgtctatggtgctgtccatggactacagctgctctcgggacatggacagcatcatccctgaggtcaaggtgcagtatgaggagattgccaactgcagccgggctgaggctgagagcatgtaccagatcaagtatgaggagctgcagacgctggctgggaagtacggggatgacctaagccgcacaaagactgagatctccgagatgaaccggaacatcagctggctccaggctgagaccgagggcctcaaaggccagagggcttccctggaggccgccatcacagatgccgagcagcgtggggagctggctgttaaggatgccaacgccaagctgtccgagctggaggccgccctgcagcgggccaagcaggacatgatggggcagctgcgtgagtaccaggagctgatgaacgtcgggcttaccctggacatcgagattgccacctacaggaagctgctggagggcgaggagagccggctggaatctgggatgcagaacgtgagtatccatacgaagaccaccagcagctatgcaggtgggctgagctcggcctatgggggcctcacaagccccggcatcatctaccgcctgggctccagctttggctctgccgcgggctccagctccttcagccgcaccagctccaccagggccgtggttgtgaggaagatcgagacccatgatggcaagctggagtccgagtcctctgacgtcctgtccaagtga

SEQ ID NO: 2678 - DNA, 2201 bp, Homo sapiens
gggcgggcgaggagctgcgcacgcgcggggacgcgcgcccggcctgtcgctgtggaaaccgctaggccagcgctcgccgggacctggaatccctgtacgccgaggtgggagccggtggaccggtcccccagccggcccccacctccgcttcccggtgtttgagggttcgggcctcccgccggggagttcacccctcgggctcgtcagtagggctgtggctgtcgcctcttcctgcagcgccaggctccgcccggtctcacagtcggcttaggggctttgcgtgcactgcggttgggtggaaaaacccactcctggttgtttagacgttggcctgcagacgatgtcatttctgtattcctctaaggcaggaagtcattatgcaacttacacatattcatcagatttcctctgacttacccggacatgtacatgggaatgatgtgcactgccaagaaatgtgggattaggtttcagcctccagctattatcttaatctatgagagtgaaatcaaggggaaaattcgccagcgcattatgccagttcgaaacttttcaaagttttcagattgcaccagagctgctgaacaattaaagaataatccgcgacacaagagttacctagaacaagtatccctgaggcagctagagaagctattcagttttttacgaggttacttgtcggggcagagtctggcagaaacaatggaacaaattcaacgggaaacaaccattgatcctgaggaagacctgaacaaactagatgacaaggagcttgccaaaagaaagagcatcatggatgaactttttgagaaaaatcagaagaagaaggatgatccaaattttgtttatgacattgaggttgaatttccacaggacgatcaactgcagtcctgtggctgggacacagagtcagctgatgagttctgataccaaacactcaaaacatgcattgggctagcagaatatccatgtttattaccagactggttctggaagaagctgtaaagaatactaaatatgttgggttataggggattgaccatgttacttttcaaaaccaggacatttaaagcatctactatgtaggtgcatgaggagtatgggaaaaacagaataaaggaatctgcctttaaggagcttacaatcatgccgggtgcggtggctcacgcctgtaatcccagcactttgggaggctgaggcgggtggatcacctaaggtcaggagttcgagaccagcctagccaacatggtgaaacctcgcctctactaaaaatacaaaaattagccaggcgtggtggcgggtgcctgtaatcccggctactcaggaggctgaggcaggagattcgcttgaacctgggaggctgaggttgcagtgagccgagatcgcgccattgtactccagcctgggcgatgagcaaaactccatctcaaaaaaaaaaaaaaaaaaaagcttacaatctgactggaagatgtcaaaacctgtgaaaagctaattagcagtattaagcaacacaaacattagtgccaaatgcatgataaaggctaaagaaggccagagcatatattactgtagagtagaatagtaagggaagactttgtcctttagtaaagagataggaggtggcctggcccttgaaatagtagtgtttaggtagatgcttgtgtaggattcctgataagagcaactgaaaagaaggagaggggaagtagtaaagggacaagaaacaattttttttttgaggaaccataagcaaattatagtttgacaagacaagattgggggacatatatggttaccagggaattacctcttatgtgttatatctttatattatttatctctggaaaagagtaccctgcaaaattccctacagctgcaagcagatgtcacttgatggacagagggggaattctgcccctccggtatcgggaaatacatactaaagacattgcgaaacgctgaacctcttcccataaataaaaggtttgtttgtaaaatgggaaatccacccataataaatgaacaataggcactgccagtttaggcctgttcatgaatggatctgcaagacagcatcttcgtttaacaacattatctgtgatttgatacatttatccttattacaatattgtttagttggtagaaattctatgttttctacaaggaaattgatgtttattaaataaaactgaaaataatta

SEQ ID NO: 2679 - DNA, 825 bp, Homo sapiens
ctttccaacttggacgctgcagagtgagtatgggtggcggagtctgggctcctggaatccagccccatcctcctttgggattgtgctaactgggaccgcaaaatctctcccgagccagcccggggctccggttgtggggagatgggaatacaccctgcttttaaaggctcccagagcctgaggaagaaagtgaccaggcttaggggagccggagcggcagggatttccgggtcggaggcatctgaggggcgcaggggcgcgggtgcgtgggccactgggtgaccgacttagcctggccagactctcagcacctggaagcgccccgagagtgacagcgtgaggctgggagggaggacttggcttgagcttgttaaactctgctctgagcctccttgtcgcctgcatttagatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgcc

SEQ ID NO: 2680 - DNA, 3000 bp, Homo sapiens
agtggcagtcaggcctccccgctctgtgctacctgcggcccggctctcctccgcgcccccactcgcgctgcgatgacgcgctcactgttcaagggaaacttttggagtgcagacatcctcagcaccatcggctatgacaacattatccaacatctgaacaatggccgcaagaactgcaaagagtttgaagactttctaaaagaaagggcagcaattgaagagaggtatggcaaagatctgctcaacctctctaggaagaagccgtgtggacagtctgaaatcaacaccctgaagcgggcccttgaagtcttcaagcagcaagtagacaatgtggcacaatgtcacattcagcttgcacagagtttaagagaagaggccaggaagatggaagaattcagggaaaagcaaaaactacaacgaaaaaagacagagctcataatggatgctatccataaacaaaagagcttacaattcaagaaaaccatggatgcaaagaagaactatgagcagaaatgccgggacaaagatgaggcagaacaggccgtcagccggagtgccaacctggtgaacccgaagcaacaagaaaagctttttgtgaaactggcaacttcaaagaccgcagtagaggactcagacaaagcatacatgctgcacatcggcaccctggataaggtccgagaagagtggcagagtgagcacatcaaggcctgcgaggcatttgaggctcaagaatgtgaacgaataaacttcttccggaatgcattgtggttacatgtgaatcagctgtcacaacaatgtgtcaccagtgatgaaatgtacgaacaagtccgaaagagtttagaaatgtgcagcattcagagggacattgaatactttgtgaatcaacgcaaaactggacagattccaccagcacccatcatgtatgagaatttctactcctcccagaagaatgcagtcccagcaggaaaggctacagggcctaacttggcaaggagaggacccctcccaattcctaaaagctcaccagatgatcccaattactctttggttgatgactacagtttgctctatcagtaaaatcaatgaaaccagagctttttccggctagtgcttctgtgatatggaaagggcacccagagcagcaggacctatagccacgttatgtcagcaatgaagactttgaagtgaacccttgctataattttttagagatttaaaatttatggtagacatttaggacaacataagcaagtagagttctgcagttttttgaagtttacaaattgccccattctgaagaattattctttcccagttactcaggttatgaatgaattaggttttcaacatgggaagcatgaaatccacttctggatttggagcatccacttgaggagcagaggtggcagcagaggattctgagccaccaactgcagtagtggctcctttggctttgggcagcctggctgtggagtttccacggcgacacacagcctcagtggtgcaagatttaaaattaccttcctttttggctggaagacttagaagccgcctgatcatactttctcattttacagatgaggaaataaagcctacaagtgtgaaattaatttccttacagttttcctagctgatgagggacagaaccagaactagagcctgagcccaacccacatcactattcttctaacccttcctgaagttgtgatgctcatgctgaaatttaagatgccaaatatttttgccagcactttttcagttgggagaatcaccagggtttaaatgtcagatttatttttatgtggatccctgtgtatgctgaactacagagcatgatgtttaatctaatttaaggagccactgattgtaaaacatgccattattttatgttgcactaagaaggtggggtcgaggagttgccaataaacttgggacagactattgatggccaagcccatctgaatttaagatgctaaagtatgaaaaaaatacatcttagaatcaatgaaataccatattttgattccattcctcaagataattttagagttataaaaccagtcctcaattttgggtcttcacagagaatctttcccttgctagaccccagaattttaaatgcatccgtcttacactttcacaaatatttgggttttcctttttcactcacaaacagcagggaggtcatgtactttttgtacaacacctgtgcactatgagaaaatggtaccttttagttattgacaagttaaaatagcactctcagtttttcagtattacagagagcaaatagtttcctctcctgctctgtgcagtagcttttccagaactatggacaaattgatcagaagaagattgattatttcctcatctttttttcttttttttgagacagagtctctctctgtcccccaggctgaagtgcagcggcatgatctcagctcactgcaacctctgcctcccgggttcaagtgattctcctgcctcagcctcctgagtagctgggattacaggcacccaccaccacacctggctaattttttgtatttttagtaaagacagggttttaccatgttggtcaggctggtctcaaactcctgacctcaggtgatccacctgcctcggcctcccaaagtgctgggattacaggcgtgagccactgcgcccggcctatttccccacctttcgtgtaaggtgctactgaacatgacagcttcttgtcatgacaggaaacttgcatcagttggatatccttttgagaaactgaattttgcaaagggccaaatttccccaaactgaacgggctcaggaaatgttcctttacactcagaacattctattttaagtatattatttattgttggcagttcctcagggatttcccttttctctgtattggtcagtgtagttgatgtaaaaccgttttgtggatggaaaatatttttattttattgctcttttagtttggtaggttaaataaaggttcttggtaatttggga

SEQ ID NO: 2681 - DNA, 936 bp, Homo sapiens
gcttccggcaccggccgaggtgcgggtcgcctccagagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcagggttgtgtgttggatttgacatagatgaagacgcattggaaatatttaataggaatgcagaagagtttgagttaacaaatattgacatggttcaatgtgatgtgtgcttattatctaacagaatgtccaagtcattcgatacagtaattatgaatcctccctttgggaccaaaaataataaagggacagatatggcttttctaaagactgctttggaaatggcaagaacagcagtatattccttacacaaatcctcaactagagaacatgttcaaaagaaagctgcagaatggaaaatcaagatagatattatagcagaacttcgatatgacctgccagcatcatacaagtttcacaaaaagaaatcagtctgatcatctaaatcacccgaaaatttcagcaagcatccaatcttttcttctagagatttctataaaaatatacaaagtgatcaaaaagtttcttaaaagcaacaacagaccagaaatgactcacaccaccttatagctatacaagaaaaagactagaaaccaaaatgctattttaaagtagtttcttccgccggggcagcaagagcgaaactccatctcaaaaaataataataataataaataaataaagtagtttcatag

SEQ ID NO: 2682 - DNA, 2221 bp, Homo sapiens
gggacttcaccagtgctgccatgctggccccaggctgtgagttggacccagaccaagaagtggtgaggacaaggcctgaagatgtgcctgcttccccttcaacttccaccatgattgtaagtgtcctgaggcctcccagccatgcttcctgtacagcctgtggaactgtgacttttcacatagtagagagaatggcttcagttatacctgcctccaataggtccatgagatctgacaggaatacatatgttggaaaaaggtttgttcacgttaaaaatccttacttggatttgatggatgaagacattctctatcacttggatttgggaacaaaaacacacaacctaccagcaatgtttggagatgtaaagtttgtctgtgtcggtgggagccccaacagaatgaaagcatttgcactgtttatgcacaaggagctcgggtttgaggaagctgaagaagacataaaagacatctgtgctgggacagacagatactgtatgtacaaaaccgggcctgtgctcgccatcagtcacggcatgggcatcccctccatttctattatgcttcatgaactcatcaaattactccaccatgcacggtgctgcgatgtcaccattattagaatcggtacatcagggggaatagggattgcaccagggactgttgtaataacggatatagctgtagactccttctttaagccccggtttgaacaggtcattttggacaacattgtcacccgaagtactgaactggacaaagaactgtctgaagaactgttcaactgtagcaaagaaatccccaacttcccaaccctcgttggacatacaatgtgtacctatgatttttatgaaggccaaggccgactagatggagcactgtgctccttttccagagaaaaaaagttagactacttgaagagagcatttaaagctggtgtcaggaatattgaaatggaatctacagtgtttgcagctatgtgtggactctgtggtctaaaagctgctgtggtctgtgtgacacttctcgacagactcgactgtgatcagatcaacttgcctcatgatgtcctggtggagtaccagcaacggcctcagctcctaatctccaacttcatcagacggcggcttggactttgtgactagacgtcctaactgggcagcccaaccctcccctgcaagtttgtagctcaagttgtaatgtgaaagtcatattttatttgtggcatttttatatagttctcatccacatgctaaatggaaagactttatgaaatccttctctcttaaaaaggaatttattgtaaaagaatactcacactaaattaaattcaaatttcattttagaataagttaactaaatcagtctaataattaaaattttaaaactcctggattatgacatttggagtttcatatgcagcattaattaagctcacatcaaaatagaccagccatttgcacatagttaccagtcactctgtttctgaaaccaatccagaaattcatgttagaacattgtcaggcacttctaggtattggacaagtgacagaaactgatcatccatattcaaaatatttacagaaaaaagtgtcagtgaaatgtaggtctatatggaaaagttaccattaggaaaatatggccatactgcttttttacccctgcactatttcagtgcaccacagaataggattcgagatttacatatgcctgtttgtgattttatctcagaatataacaactctggattacattttcctctcaactgaaaaccctcagtaatgcaaagaaaggccttcctttttcttcagaatcacaagtgactaaattgccttctagccattttttcttgtaaaaaaagtgttttgaggaggctgtattttttattccatttcaatattaaccaaataggctgagaaattcatagcaattgaattaagacttgagttcaagatgttaaaggaatccttttgtatgacttgtccagaccggcctattgccctacccgtttgattctctgggaggcatggtgctcctcctggctgcacatgctctctgtgaactgatcgcatcttgggttcttctcaatttgacatacttgggagtcggaatgactggatgggggatgggtagaggatgactggcacacttgtatagtatgtaatgttgtgtacatattatttatatggttgtggctcaaataaagtttaattccaacaca

SEQ ID NO: 2683 - DNA, 4782 bp, Homo sapiens
gccgcggagacccggcagttgggggatgccgacgcctgggccttgaggatgctgcggaagctcaccatcgagcagatcaacgactggttcaccatcggcaagacggtgaccaatgtggagctgctgggcgcgccgcccgccttcccggcaggggcggccagggaggaggtgcagcgccaggacgtggcccccggcgctggtcccgcggcccaggctccggctctggcccaagctccggcccggccggccgctgcgttcgaaaggtcactcagccaaaggagctcagaagtagagtatattaacaaatacagacagctcgaagcacaagagcttgatgtgtgtcgcagtgtccaaccaaccagtgggccaggtccaaggccatctttggctaaattaagcagtgtgacatgcatcccagggacaacttataaatatcctgatttgcctataagtcgatacaaggaagaggttgtgtctttgatagaaagtaattccgtggtgattatccatggggccacgggaagcggtaaaagcactcagctcccgcagtatatcttggaccactacgttcagcgctccgcctactgcagcattgtggtcacccagccccggaagataggggcaagcagcatcgccaggtggatcagtaaagagcgtgcctggaccctgggaggtgtggtgggctaccaggtagggctagagaaaatagcaacagaggacaccaggctaatttatatgacaactggagtcctgcttcagaaaatagttagtgccaagagtttgatggaattcacacatatcatcattgatgaagtacacgaacgaacagaagaaatggatttcctgctattggtagtccgcaaactcttaagaacaaattcacgttttgtgaaggtggtcctgatgtcggctaccatcagctgtaaagagtttgcagactactttgctgttcctgttcaaaacaagatgaatcctgcatatatttttgaagtggaaggcaagccccattcagttgaagagtattatcttaatgatttggagcacattcatcatagcaagctctctcctcatctcctggaggaaccggtgataactaaggatatatatgaagttgctgtctctctcattcagatgtttgatgacttggatatgaaggagagtgggaacaaggcttggtcgggggcccagtttgtgttggagcgaagcagtgtgttggtgtttttgccaggtctgggtgaaataaattatatgcatgaacttctcacaagcctggttcataaaaggttgcaggtctatccactccattcaagtgtggctttagaagaacagaataatgtctttttaagtccagtccctgggtacagaaagattattctgtccaccaatattgcagagagttctgtcacagttccagatgtcaaatatgttatagatttttgtttgactagaactttggtctgtgatgaagatacaaattatcagagtctgcgattgagttgggcttctaaaaccagctgtaatcagagaaaaggccgtgctggacgagtgtctagagggtactgttaccggctggtacacaaggatttctgggacaactccatccctgatcatgttgttcctgagatgttgcgttgtccattaggaagcacgatcttgaaagtgaaattacttgacatgggtgagccgagagctctgctggccactgccctttccccgcctggtctgagtgacattgagcgcaccatccttctactaaaggaggttggagcacttgcagtgagtgggcagagagaagatgaaaacccccatgatggtgaattgaccttcttaggaagagttttagcccaacttcctgtaaatcagcaacttggtaaactcatagtccttggacatgtatttggatgtctagatgaatgtcttattatagcggcagctctttctttgaagaatttttttgcaatgcctttccggcagcatctcgatggatataggaacaaagtgaatttctctggcagtagcaagagtgactgtattgcacttgttgaggcatttaaaacatggaaggcttgcagacagacaggggagctgcggtacccgaaggatgaacttaattggggacggttaaattacattcaaatcaagagaattagagaggtggctgaattatatgaagaattgaagactagaatctcacagttcaacatgcatgttgattctcggcgacctgtcatggaccaagagtatatatataagcagcgattcatcctacaggttgtattggcaggtgctttctatccaaattactttacttttggacagccggatgaggagatggcggtgagggagctggctggcaaggaccccaagacaactgtcgtgttgaaacacattcctccctatggatttctttactataaacaactacagtctctctttagacagtgtggtcaagtcaaatccattgtatttgatggtgcaaaagcctttgtggaattctcacgaaatccaacagagagatttaaaacccttcctgcagtatatatggcaattaagatgtctcaactaaaagtttcacttgaactcagcgttcattctgcagaggaaattgaagggaaggtgcaaggcatgaacgtctcaaagctcaggaacacaagggtgaatgtggacttccagaagcagacggtagatcctatgcaagtctcctttaacacatcagacaggtcccagacagttacagatctccttctaactattgatgtcacagaggtggttgaagtgggacacttttggggatacaggattgatgaaaacaactcagagattctgaaaaagcttactgctgaaatcaaccaactgacgctggtgcccttgcccactcacccacatccagacttggtctgtctggcaccttttgctgattttgataaacaacgctactttagagctcaagtcctttatgtttctggaaattctgctgaggtattctttgtagattatggcaataagtctcatgtagatctacatcttttgatggagattccctgtcaatttcttgaacttcctttccaggctttggaatttaagatttgcaaaatgagaccatcagcaaagtctcttgtttgtggcaagcactggagtgacggggccagccagtggttcgcctctctggtgagcggctgcaccctccttgtgaaggtcttctctgtggtgcacagcgtcctgcacgtggatgtgtaccagtactcaggggtccaggatgccatcaacataagagacgtcctcatccagcagggctatgccgagctcacggaggagtcctacgagtccaagcaaagccatgaagttctcaagggcctcttttccaagtcagtagaaaacatgacagatggctctgtgccctttcccatgaaagacgacgagaaatatctcatccggattttgttagagagcttttctaccaataaactgggtactccaaactgtaaggcagaacttcacgggccttttaacccttatgaactaaagtgccatagtttgaccagaatatccaaattcaggtgtgtttggattgagaaggagagcatcaactctgtcattatcagtgacgcccctgaagaccttcaccagagaatgctggttgcagcttccctttccatcaatgcgactggatctacgatgctgctgagagaaacctctctgatgcctcatatccctggcctcccggctctcctcagcatgttattcgcaccggtgatagagttaaggattgatcagaatggcaagtactatactggagtcctttgtggtttggggtggaatccagctacaggggcttccatactgcccgagcacgacatggagcttgcgtttgacgttcaattcagcgtggaggatgtcgtcgaggttaatattctcagggctgctattaacaagctagtctgtgatggaccaaatggatgcaagtgtcttgggccagagagagttgcgcagcttcaagacattgcccgtcagaagcttttaggtttgttctgtcagtcaaaaccaagggagaagattgttcccaagtggcatgaaaagccctacgagtggaatcaggttgatccaaagctggtcatggagcaggccgaccgtgagagcagcagagggaagaacacctttctctaccagctccacaaactggttgtgctcggcacctgagcatgtccacaggtggcctccagcacacccctcaggaagctgtggaggctggattccaggctccctccgcagactgactttcctctgtgtctgggtgttacagtctgtgcccactgcatcctaaaggccttttctttcttcttttctctttgggtgatagtcagagagtggtgtttttgttcaggtgggaaggattggaaactctagtcttttctagaaacagaaaatcactgtattaaatattttggaaagattgttctgaaagaagtctgtttggataaagagctgtattttgctttaaatttattaaggtaaatataagtagttaatcttagatgtaaggttccagaatgtgcttacatattctgttctgttacagtgatttaaaccagtagtataggaaaaaacttaaaaaaacaaaaaaaccatgtagtattttctgatttttttttccatgagggaaaatatctaatttttataagactaagttgagttatacttcttggttcacattttggaaatcagagattacagattacatggccatagcttatctgtgttaaaacaataaaagcattaaatgaa

SEQ ID NO: 2684 - DNA, 944 bp, Homo sapiens
cagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcagtgaggacccccaagaggcccatttcccccaataaaagagatttgggagtctgcctggttgctgcctctttttcccgcccctccctgggatgggtcccactccctgtgggctccttttggggcttgtgcttggcagttcctgtgctgtcctgtctcccagatcctgagaccctggctgagaacttggcccagcctgctgcttaaaggcaccatggggacctgggttgccctgagacccaagccattgttagcagctagccagccacaccaaccacgccagggggaggaaagggaaggactgggagagacacaaagaccagagccagcctcagggacaagagattccagttttaggcctttctccttctaagtgccccccacccccatagcctgcatgtccactcccagacgatggccaagagcagaaacacaagctggagccagtgtcctggtttgacagcatgttcaacgagggaaccccaagacggacccacacaggtccacccacgctgggggctgtaatcacggagggaagtggctgcccccttaacacacctttaataaacagtctacagaccca

SEQ ID NO: 2685 - DNA, 3842 bp, Homo sapiens
gcgggagcttctcctgccaggcaggaagacgagtagaagggagcggcatgctggaggctggagcctgagcccctggggctcgccttgctgtgtttggtggtgacgtgggacactgcagctcggccagagtggtagaaatgtcctggtgtaggcttttctggctttgcccgtctagctgctccaagccaggctggaggaggaggagaaggaatcacctgtggtacgctggagcctgcatgtggcgtgactctgcagctcgcctcgtgtgactgatggcagccacggagactgcagctcgacaggagtgattggaaacccggagttacctgctagttggtgaaactggttggtagacgcgatctgttggctactactggcttctcctggctgttaaaagcagatggtggttgaggttgattccatgccggctgcctcttctgtgaagaagccatttggtctcaggagcaagatgggcaagtggtgctgccgttgcttcccctgctgcagggagagcggcaagagcaacgtgggcacttctggagaccacgacgactctgctatgaagacactcaggagcaagatgggcaagtggtgccgccactgcttcccctgctgcagggggagtggcaagagcaacgtgggcgcttctggagaccacgacgactctgctatgaagacactcaggaacaagatgggcaagtggtgctgccactgcttcccctgctgcagggggagcagcaagagcaaggtgggcgcttggggagactacgatgacagtgccttcatggagcccaggtaccacgtccgtggagaagatctggacaagctccacagagctgcctggtggggtaaagtccccagaaaggatctcatcgtcatgctcagggacactgacgtgaacaagcaggacaagcaaaagaggactgctctacatctggcctctgccaatgggaattcagaagtagtaaaactcctgctggacagacgatgtcaacttaatgtccttgacaacaaaaagaggacagctctgataaaggccgtacaatgccaggaagatgaatgtgcgttaatgttgctggaacatggcactgatccaaatattccagatgagtatggaaataccactctgcactacgctatctataatgaagataaattaatggccaaagcactgctcttatatggtgctgatatcgaatcaaaaaacaagcatggcctcacaccactgttacttggtgtacatgagcaaaaacagcaagtcgtgaaatttttaattaagaaaaaagcgaatttaaatgcactggatagatatggaagaactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccagaacaagacttaaagctgacatcagaggaagagtcacaaaggttcaaaggcagtgaaaatagccagccagagaaaatgtctcaagaaccagaaataaataaggatggtgatagagaggttgaagaagaaatgaagaagcatgaaagtaataatgtgggattactagaaaacctgactaatggtgtcactgctggcaatggtgataatggattaattcctcaaaggaagagcagaacacctgaaaatcagcaatttcctgacaacgaaagtgaagagtatcacagaatttgtgaattactttctgactacaaagaaaagcagatgccaaaatactcttctgaaaacagcaacccagaacaagacttaaagctgacatcagaggaagagtcacaaaggcttaaaggcagtgaaaatggccagccagagaaaagatctcaagaaccagaaataaataaggatggtgatagagagctagaaaattttatggctatcgaagaaatgaagaagcacagaagtactcatgtcggattcccagaaaacctgactaatggtgccactgctggcaatggtgatgatggattaattcctccaaggaagagcagaacacctgaaagccagcaatttcctgacactgagaatgaagagtatcacagtgacgaacaaaatgatactcagaagcaattttgtgaagaacagaacactggaatattacacgatgagattctgattcatgaagaaaagcagatagaagtggttgaaaaaatgaattctgagctttctcttagttgtaagaaagaaaaagacatcttgcatgaaaatagtacgttgcgggaagaaattgccatgctaagactggagctagacacaatgaaacatcagagccagctaagagaaaagaaatatttggaggatattgaaagtgtgaaaaaaaggaatgataatcttttaaaggctctacaattgaatgagctcaccatggatgatgataccgctgtgctcgtcattgacaacggctctggcatgtgcaaggccggctttgcgggcgacgatgccccccgggctgtcttcccttccatcgtggggcgccccaggcagcagggcatgatggggggcatgcatcagaaagagtcctatgtgggcaaggaggcccagagcaaaagaggcatcctgaccctgaagtaccccatggaacacggcatcatcaccaactgggatgacatggagaagatctggcaccacaccttctacaacgagctgcgtgtggctcccgaggagcaccccgtcctgctgaccgaggccaccctgaaccctaaggccaaccgcgagaagatgacccagatcatgtttgagaccttcaacaccccagccatgtacgtggccatccaggctgtgctgtccctgtacacctctggccgtactactggcatcgtgatggactctggtgacggggtcacccacactgtgcccatctatgaggggaatgccctcccccatgccaccctgcgcctagacctggctgggcgggaactgcctgactacctcatgaagatcctcaccgagcatggctataggttcaccaccatggccgagcgggaaatcgtgcgtgacatcaaagagaagctgtgctatgttgccctggacttcgagcaggagatggccacggtggcctccagctcctccctagagaagagctacgagctgcccgatggccaggtcatcaccatcggcaacgagcggttccgctgccccgaggcgctcttccagccttgcttcctgggcatggaatcctgtggcatccatgaaactaccttcaactccatcatgaagtctgatgtggacatccgcaaagacctgtacaccaacacagtgctgtctggcggcaccaccatgtaccctggcatggcccacagaatgcagaaggagatcgctgccctggcgcctagcatgatgaagatcaggatcattgctcctcccaagcgcaagtactccgtgtgggtcggtggctccatcctggcctcgctgtccaccttccagcagatgtggatcagcaagcaggagtatgatgagtcaggcccctccattgtccaccgcaaatgcttgtaggtggactctgacttagttgcgttacaccctttcttgacaaaaccaaacttctcagaaaacaacatgagattggcatggctttatttgttttcttgtttcattttttgttttgttttttattggcttgactcaggatttaaaaaccggaatggtgaaggtgacagcagtcggttggaggaagcttcctccaaagttctacaatgtggccaaggac

SEQ ID NO: 2686 - DNA, 829 bp, Homo sapiens
cgcaggttctatagaatttgccaagactgctggcctgttttctaccctgattccttaggtggcttctgggacagaattacggttctctaagtatttgcttgcagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataag

SEQ ID NO: 2687 - DNA, 2811 bp, Homo sapiens
atggagccagacatcattcgaatgtactcttcatccccaccaccattagacaatggagcagaggatgatgatgatgatgaatttggggaatttggtgggttttcagaagttagcccttctggtgtagggtttgttgatttcgatacaccagattatactcgtcccaaggaagagtttgtaccttcaaaccattttatgccaattcatgaattctcagaaaatgtagatagccttacaagctttaagtccattaaaaatggtaatgataaggacatcactgctgaactttctgctcctgtgaaaggacagtctgatgttttactttctaccaccagcaaagaaataatttcatctgaaatgttagctacttccattgatggcatggaaagaccaggaaatttaaataaagtagtggagcagagacagaatgttggaacacttgaaagtttctctccaggagattttagaactaatatgaatgttgttcatcaaaacaagcagttagagagctgcaatggtgaaaagcctccttgtctggagattctaacaaatgggtttgcagtgttggaaactgtaaatcctcagggaacagatgatctggacaatgtagctgattcaaagggacggaagcctcttagcactcatagcactgagtataatttagactctgtacctagtcctgctgaggaatttgcagattttgccacattttccaaaaaggaaaggatacaattagaagaaatagaatgtgcagttttaaatgatagagaagcactaaccattcgggaaaacaataaaattaatagagtcaatgaactgaattctgtaaaagaagtggctttgggtagaagcttggataacaaaggagacactgatggagaggatcaggtttgtgtttcagaaataagcatagtgactaacagaggtttcagtgttgaaaaacaaggccttccaacactgcaacaggatgaatttttacagtcaggtgttcagtcaaaggcttggagtttggtagactcagctgataattcagaagccattaggagagaacaatgtaaaactgaagaaaaacttgacttacttacttctaaatgtgctcacctatgcatggattctgttaaaacttctgatgatgaagttggttctcccaaagaagaaagtagaaagtttactaatttccaaagcccaaacattgaccccacagaagaaaatgatttggatgattctttaagtgtaaaaaatggtgatagtagtaatgactttgtgacttgcaatgatatcaatgaagatgattttggtgattttggtgactttggctctgccagtggctcaactccaccttttgttactggtactcaagattcaatgagtgatgccacttttgaagagtcttcagagcactttccacattttagtgaaccaggtgatgactttggagaatttggggatataaatgctgtttcttgccaagaggagacaatattaacaaagtcagacctaaaacagacttctgataatttatcagaagaatgtcaattggcaagaaaatctagtggaacaggcactgaacctgttgcaaaacttaaaaatgggcaagaaggtgagattggacattttgattctgtgccaaatattcaggatgactgcaatggttttcaagactctgatgattttgcagacttcagttcagctggtcctagccaagttgtagattggaatgcttttgaggatgaacaaaaagatagttgttcttgggctgcttttggagaccagcaggctactgaatctcatcatcgaaaggaagcctggcagtcacataggacagatgaaaatattgatactccaggaacccccaaaacgcacagtgtaccttcagcaacttccaaaggagcagttgctagtggccatttacaggaatcagccacttcagttcagacagctttattaaaccgcctggagcgaattttcgaagcatgttttccttccatacttgtccctgatgctgaagaggaagttacttccctgaagcacttgctggaaacaagcactttgccaataaaaacgagagaggccttacctgaaagtggggaattgctagatgtgtggactgagctacaggatatccatgatgcacatggcttgagataccagtggggcggctcccatagcaacaagaagcttttgtcctccttgggaatagacacccgaaacattctcttcacgggcaataagaagcagcctgttatagtgcccatgtatgcagcaggattgggtatgttagagcccaccaaggaaccactgaaaccactttctgctgcagaaaaaatagcttccatcggtcagacagccaccatgtcaccagatatgaacacatgtacatctgatcagttccaggagtctctaccacccgtccagtttgactggagtagcagtggccttactaaccctttagatgctagtggaggttccactcttctgaaccttgatttctttgggcccgtggatgacagtagctctagcagcagcaccacaatcccaggtgtggatccggagttgtatgagttaacaacttctaagctggaaatctccacctcaagcctcaaagtgactgatgcatttgcaagactcatgtctacagtagagaagacaagcacatctaccaggaaaccgaaaagagaagagcacctaagtgaagaagctatcaaggtgatcgctggccttcctgacttaacattcatgcatgccaaggtgttgatgttcccagccacgttaacaccttccacaagctctcaagaaaaagcagacggataa

SEQ ID NO: 2688 - DNA, 10992 bp, Homo sapiens
tttctaaagtccctcaggaaaaaaattctgaaacttgagccacaaattaagaggcagacggcttttctccttgcaaatgacctgccacacagtccgtcactgcctctgctagctctgctacccttgggccctgtccacagcccacgtgggagaccttttcacgggatctactcggatgtctgggatctggccactaccgcaggctcgagacaacccaggccataaagaatgctgatgggagaaccattttcctaattttcaaattgttgagctgtttgccataatggatgatcagcaagctttgaactcaatcatgcaagatttggctgtccttcataaggccagtcgaccagcattatccttgcaggaaaccagaaaagcaaaatcttcatcaccaaaaaaacagaatgatgtccgagtcaaatttgaacatagaggagaaaaaagaatccttcagttccccagaccagttaaactggaagatctgagatctaaagctaaaattgcctttggacagtctatggatctacattataccaataacgagttggtaattccattaactactcaagatgacttggacaaagctgtggaactgctggatcgtagtattcatatgaagagcctcaagatattacttgtaataaatggaagtacacaggctactaatttagaaccattgccatcactagaagatttggataatacagtatttggagcagagaggaaaaaacggctatctataataggtcctactagtagagatagaagttctcctcccccaggttacattccagatgaattacaccaggttgcccggaatgggtcattcactagtatcaacagtgaaggagagttcattccagagagcatggaccaaatgctggatccattatctttaagcagccctgaaaattctggctcaggaagttgtccatcacttgatagtcctttggatggagagagctatccaaaatcacgaatgcctagggctcagagctacccagataatcatcaggaattttcagactatgataaccctatctttgagaaatttggaaaaggaggaacatatccaagaaggtatcatgtttcatatcatcatcaagagtataatgatggtcgtaaaacttttccaagagctagaaggacccaggggaccagcttacggtctcctgtgagtttcagtcctactgatcattccttaagcactagtagtggaagcagtatctttaccccagagtatgatgatagtcgaataagaagaaggggaagtgacatagacaatcctactttgaccgtaatggacatcagcccacccagccgttcacctcgagctccgaccaactggagattgggcaaactgcttggccaaggagcctttggaagggtctacctctgttatgatgttgatacaggaagagaattggctgttaagcaagttcaatttgaccccgatagtcctgagaccagcaaggaagtaaatgcacttgagtgtgaaattcagttgctgaaaaacttgctacatgagcgaattgttcagtattatggctgtttgagggatccccaggaaaaaacactttccatatttatggaatatatgccagggggttcaattaaggaccaattaaaagcatatggcgctcttactgagaatgtgactaggaaatacacccgtcagattctggagggtgtccattatttgcacagtaatatgattgtccatagagatatcaaaggcgcaaatatcctgcgagattcaacaggcaacgtcaaactaggagattttggggccagcaaacggcttcagaccatctgtctctcagggacaggaatgaagtctgtcacgggcacaccatactggatgagccctgaagtcatcagtggagaaggctatggaagaaaagcagacatctggagtgttgcatgtactgtggtagaaatgctaactgaaaagccgccttgggctgaatttgaagcaatggctgccatctttaaaatcgccactcagccaacaaacccaaagctgccacctcatgtctcagactatactcgagatttcctcaaacggatttttgtagaggccaaactgagaccttcagctgatgaactcttaaggcacatgtttgtgcattatcactagcagccagtaacctctcctgtgcctctacctagctcccatctattcattcaccttctctctgactgcacttttcttttttataaaaaaagagagatgggggagaaaaaagacaagagggaaagtatttctcttgattcttggttaaatttgtttaataataataatatcctaaattttttatatttaatctttttttcccttacaagaacttgaagtttttttttttaatttttataatgtactgatgtggttcagagagataaagcactttagtacatagtcactctttttagtacaaacaaatcatttggaatacctaaagattgtagagtcattccctctatcactgacacatcagtgacgatgggaagacatggaaaacaaggagaagaaaatgatgtataatttgtagtttttagtgatagtatttaaaatatatcctcatttgtggggttgagccctaaactttagtttagggtaggtactcaacttaaagaatataggtttcttcttatatctgtattctttagatcctaacctctgtctaccaacctttttgctcagtaggagtcttgatagaagatatgaatctctgagaggtatgtttatttgttaatcctaaccagtataataagcaaatacactataatagatccacgttactggaatctgtaaaccttgagggatagctttctgcttaaaaacacacacacacacacacacacacacacggaaaacctttattttaaagtcaagttgtgagcaaatagaaataaaagacaaaaggacatcactcttatcaaatgtgtgagcagtagaagagaccacatttacagtcaatagaaataatgaaaaaaaattaggtgtttagtgtattttaaacagttttgttttgttttacttgagggggacgtcccaaaattaaaggaatggagaaataatcaaaatcatgtataccatcttctatttccagctcctgattccccataggtaacatcccttaggagcgaagagttcaattagtaatgtttatgtgttatgtcaggagatgaaacccttgttcttaggatcacagaatactaaagcacctcaaaaaaacaggtatcatgtgaaacagtggttgccaaaagtggagcgaggatgatttcactaggcatttggcaattcttagagacatttccggttgtcacaattggagggatactagtaacatgaattgggtagaggccagggatgttgctaaatagattataatacacaaggaaagcagcctcaaagaattacccctcccaaaatgtcagaagtgctgaggctgagaaaccctgatgtaaagatcagtcccagttataaactgaaaacagctatttacaaagcagtaaatgcaagaaagaaaaggaagtcgcaaagagaaagtgatgtaatgcaaattgaggattttacaagatcagatactgctgctttaagtcaagggtgaataatctcaacaaacagcaaatagcaatcactttaccagctgcatattgcacccacataggtaactcttcattttaggaacaaactgaatttgaacactgagccttttgaactcagccatctctatatattctttccttaaaattcatgattttgggcaaaaaaaaaaaaaaaagcatatcaaaacaaaattttaactactaatgggaaggttaaaaagctgccacgtatttctagtacaatgtatccaataagagcaaggacattgttaaatggaacaagacagctgggaaaggccccactatctctaatagaattgtgctactataaaacatgaagatatcagcaatttggccacttgcagtttttttcagcatgttaaagcaagtgctaagtactttattagtactttatttagtactttattttaaaggtctagaaaacaacagtcttcctggaggccccagaatccctttcatgggattcataagggactcaggtattcttattttctgccaaaaggtgtgcttatttagggactcttttacgatactttgtttctgaagttaggtagatcttggtttactgtgccaaggtcctacctagcattccctgtaggaatatttgaaattccactagctagtctaagaagtcaaagcacaaaattaattgtcaacgcttctctcatattcttaaaattgaagcagtttgcagggaagaacaagaatgaggtgtccctgccttggtaaagcaactgccaaattttgttctagaaagaatccccaagtgtgtggatctattataatttctttatcttttatgaatgagggcatcttttctacttgagcaagatcatggtccttgaccagtgggcttttccttcatatctgtcttgtgtagttgtgcttttcctttggctcgtttttggtctgtcagggtaaccagcagtgcacaatatgagacaaatgctctttagagagaaatctggtgagactgtagaacccagagcaaaactgtttttttttcagtctctgttttcttttctaaatgctatagaaaataaaggcacctgaaaagaaactactactttaacactgctgtggaaggcctttgctttataagaaaaatattattagctatgggaaagtaatgttctttatgtaaagacttaaaaatagactaatagtttacagagttattatataaaatacgatgtgaatttatttcaaacaagttgtgaaggtaccaaaaaccacaataaaagttaatatatataaaaactactagaacaaaaaagcttgaaggtgtgggggtggagggtatggaagaccaaaagtaaatttaaaaaagaaatttttgaaaggaaacagctttatcaggggaagttaaatataacactccgtttttttcttctttctaataatgatatggatcaacaaatgcaatttgaactttttaagataactctaaatgtgttttgtttcttaaatgcacaattgattcttctatactgtaatgcttctttgctgacgctggaaaatggtcagactgctgactttgtgcctttaaaatgcattctgctttgacagtggcagactttttggtgctggagaagattcactagcagtcttatatgtgcttttcaggaaatatctttctacttaaggccttgagagattcaaagtggcatgacttaggcttggaccaaatataagatcttttacattgcaaacaaaatgttgtattgaataaaagggttaaaaaaatcataatgactagtggaaattttgatgggttgttaattatttaaaatgtatttgaaagtatacagactgaaaatttcagtatgaatatcttgaaaattttcagcacttttccttgtttacaaaacatctttctaacttaaaaaaatgactattgccttagaaagttttaaaaggcacagttacccttacataacatatataaggaattaaaatattaatgcatttgctgaactgtaaaagaaaattttaaaccttgatttcagagtgaattggattggctttcacttgagagagtctttaccttattcccaaagaaactgcattaaaaagatgaaactatttctttagactaagtctctgctactccagctcatatatatgtcagatctgctctgtagtatttctgacatggagttgttataagatatgtgaaatcacttagaaaataaaatcagatgtgaatagtttagcaggatgaccaagccagatgcagactccttggcctatggcaaagttctgtgccagtgattttatttggagtctgggaactgatagcttgatataaaatcacctggtgtcaattaaatatacaaatctatcttttttaatagaatgaatcttctttgtttgttcaataattgtaacttattatgtcaggtactaaattaacatccttaaggaggtcacaatctaggaggaacatgggcaaacagttacttattttatggcatacgctaactctgaaagttcagcaatgatgttttaaaatgttattttttattaagggaaaagcaattttaggtaatcattggctgttataaacggaaatgtcactgacaacagggattagagtaaaagtatctccaaactagagggatcccctccccaaccaggtcacatagcatctctctcaggaccccctcttactgcaaaacccagcctctactcaacagttctggtgatggggagcatttattccataacagtgtttttttgttcttttttttttttttccccagtgtctcttttaaagaaaacatactttattttggtctaaattgtgaaaatacccaaaacatttgatagaaattgaactctgtcaacagtgttatttatactaagatcaggacagttccttgagatcatactgttttattactaagtttggcctttgttttacaaatgtaatgttcatatttatttgaattttaagattggttaaatgttaatgaaaagcaatccaattgttaatttttagtagtgccttttctctgtatgccttaattttattttatattaataattcaagttacccaccaaaatgaagattttttccaaaatcagtaggcttcacaagttcatttggccttagactgtgtattggtccttaaatgtttcttaatgcctgcctcctcctacccttttctacctcctttttaaaaaaataaataaataaataaataaatgttaggagagaaacattaggatttgtctgtgatagacatgctgcagcttccactagacatgaattcccaacacaagcatagaaagaggtattctcgttctaaagagacatgtaaatgttttctgggttgaatatttgattttcaatcacattggcactgtccaagttcttggcatattatagttcagttatgattttcatggtagagttacaatacttgtttttgccctaaagaagtcattcacatggtttacaaatgttaaggcaatgagataggacagtgagtaggaaatccagggatagcagattctagtccttaattctcagctaacattttgggtaatactcacagaaaagttacttttctgtgaagtgtgtgcatgtgtgcatgtatgtgtgcgtttgcatgcatgtgtgtgtgtgtgtgtgtgtggttagagttggaggcagggatgggaaggaagaaggggaaaggtatgagtgttcaattaggtcagtttctggttttggaagaacaactcaaatgtatgacctactgatgacatacagtgagtgtagtcatccttgggtaggaacaccagtacattttccagaagtagctagtacaaatgattgtataataatattgattgtaaattgccatactcttggttgctaaaggtagattaaaattcaatttgtgtatatgtaaaataatcttatatataattcttaaatagaaagtaattgattttacatagttcttcctgaactttttggaactgaaattctgccaaacattatcaaaataagcttccttagcttaccaagtattcacaaggaaattctcttgtacctctttttggttggctaggggaagcatgctgtgaagcagctattcctacttatagttgtctttggcttggctttgacttctgccatggtttggacaggatgccatggtaggtgtgggaagtatcagggcctcccatcttcccatactcaccttccagagctgttgatggaaatgagctcttgggggagcctagagattcttttttcagtggtcctgtaagcattcaaggttgagcttcagaaagatgagggaggagtcatagctacagtaaagaaaagaatagattttatctgttgcctgtatacagtctcatagaattcttatttttcataattgtgcattttaattgatagtcatatggtatttttgttaataacagcaaaggcattaaatcagtaccattgttccttctgcctgatgacttcttgtttgtaacacaatctgtattatcagaatcactttaaaccaaagcttttatattccctgtacacatagccaaaataattagcactgttacttctgtccacttgtaagctaatagtataaaaattataaagcagatactagtagaatttgtattctggtatatccttcaaggaaaaggacaggtgatcagtgcatttagacatccagaagttacttccactattgaggaactatgtagacatgaatttaagcttgtacatgtgccaatcttgttaatgtcacttgaccactgattcacatagacagacattaacgtctgatgcctcaggttgatggcgaactttcttcctagtgtcttaacatttatgaacttatgtttgacttgaggggcatttcagcaaagctgtgaggaaaagtaggttctggactgatgtctgctttgtgccatagacattttggaacataaggaagtatctgcttctactatatgtacaggacttgtccccaaataatttctgaatcccttaatgcagttgagaatcccttaatgcagttgagaacagtaaagttcatgaccataccgaaaagcacttttaagttcacttctttttaaatatttttttagaatttattttttaaaagcatatgtaactagtgatgattttagcattagctttacttggaggggagaagaaacaaaattacaccttaaactctattagatagactacaaaatggatttgatgtattcttacttttccaaagaattttttccacctggaataagaagagaggactagttgaaacatttgagctggagaggcttatgggcaatatgaagtgggccaaattcttgcaatacaccctattcaattgaaagtacagtgtctaaggataagaatacttctttaaagaccaacaattgttttaatgcaatcttaattagtaaatggtttacattttttctattgttattggttttaaaatttgctaccctgaattctgaaatattataagagttaataccaaaaatacttttaatgtctgacatctcttacatttcacatggttctttttattcattgtaaataaaagtaaacttggataaatttgagaataaactttgaattgttgcaaactatgattatcaatttgtaaatttaccctttgacataataatgtacatttttaaatgtagccattaaattctctatatttaacctattggtttctctctaaatgtttttaatctcagttgaatgctgggcagtttataattatgtacaaagggtttttttcctattaagattgacatttttgcacatttttggaaatgtttaatttgtacactgatttactactctgaccaataattgttgatgagtgtatgagcatcatgaatgcgtgcattgaactactgtctgtgtctttatgttttaacttctttcaagatgtagccatcagttactgcactgctattactgacttaaatggacctttttgcttttacaaactatacttatctatggttctttgttgaagaactcaggagttcgacattaatagaaattagaaaattttataatgtattataaaatccattactaagttgaaagtatgcttttaactgtgtatcaggggatgtatgtttgtgtggagatgtttttttctgtctgtaggcacatgtatatatcccagtaagttcttattttcatttcatttctacatttttatgaacttgttttataagggtactgtttagttgtgataattaaatatatataaaagctttctgagagattatttactatatgaatatattttcagctggctgatcaaaagtatttttaaaattttgtttttagccattcaaaatgtatttgtattttcagaattgaatgcaagtcatacttagagctcaattaaaatactcttgcaagaaaaagcattaaattctctttgagaattccgtgaaatgcaaattaagggaaaaataggttttaagcagtagcaaaaacacaccgctaaaaatggcctttgaattctcagagctatggaaaaatgtgagaaactaaattgtctcgagatgtcaagatttttctatctccagttgctattggcctgtcctactgttgtctttgaatatttcctgtattccaccccaaaagatttcaacttttagtttttctatcactgggcaaggtcagactgggtttataaaacaatatattggcatattgtgattctttgtaattgactataaattggttttgaaatgtccaaacatacgttgtgtgtctttatattgtactgtgtgttttaagtaactggcagaaaaagaattggaaatgaaatttccaatcagacaatgtagtattaaagaaaactttgttttaaatatgcggtaccatgtaaaattactcgtgttaggaataaagtccactgttgaagttgaatgtcactaagcttattatgttaaaaggaaccagtgtgattaggaaaacctaccagaagccagatacagtgtggtacgtgcaacatttcatgcacattttgattttgtttgtcattcaaaattgtgcttgtaaaaatgtatacaatttctgagttttataatttctaggtacttgttttttcttgctggtaaatagcttttttttaaaaaaaaatctaatataaaagaaaccatgtttatattttgttagtgatcaatgactttgtttatatggaaatttgtatattgttggcacacattttgttgaggtttacgtgcatgaaggcctgcaataattagcacaatgaaaactgctttttcttacatgttcatttttttgaaagattgtggtgcaaaggcttactctaataagtaaccttctggactatg

SEQ ID NO: 2689 - DNA, 1032 bp, Homo sapiens
agaacgaggggacgtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggtgggagtacagcagccaaacgctgaacttagtcccatccacttccatcttatcctttgtgcccttcatccccctgcatcttgtcctttttgccctctggtacctcccagtgccccatcatctctacccccagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccttgagcgcctggtttgactggggacttggggggatggggttggaagaatgactgccctttcccaccaaaaaagggagaactctttagattcagattgtgggtatgtagacttaataagtgaaacatcacagaagaagcctttattatacaatgacaaccaaacaagtactccggatatgcagtagaggaatcctctaagaaccatagagacttcttttctgtgatttttgttccccacccttgaacaccatctctaggatggagttggcctaagagtgaatgctgcaagatctgtgtttatgcctcttttcctcattcttcctcagtttgttcgtctgcttgaaagttggccaaaaaatcctgctgctcaccgacttcccgtggtcagctgctgtca

SEQ ID NO: 2690 - DNA, 880 bp, Homo sapiens
gtgcgcgcgtgcggcctggcgcttccggcaccggccgaggtgcgggtcgcctccagaggtgcgtggtcgtggcgcgagggatcctgaggctgctccagcagtgcgccgccgccgtctcctggggcggcttgggttagccgggagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcagggttgtgtgttggatttgacatagatgaagacgcattggaaatatttaataggaatgcagaagagtttgagttaacaaatattgacatggttcaatgtgatgtgtgcttattatctaacagaatgtccaagtcattcgatacagtaattatgaatcctccctttgggaccaaaaataataaagggacagatatggcttttctaaagactgctttggaaatggcaagaacagcagtatattccttacacaaatcctcaactagagaacatgttcaaaagaaagctgcagaatggaaaatcaagatagatattatagcagaacttcgatatgacctgccagcatcatacaagtttcacaaaaagaaatcagtggacattgaagtggacctaattcggttttccttttaaaagccccgcaaacaaaagtcgtttaaaacctatttaaaatgaataaaaaattggtttactaaa

SEQ ID NO: 2691 - DNA, 2089 bp, Homo sapiens
ttttcccctcaggagaagtcgggaaggtggcggcggcggcggcggttgtcccggctgtgccggttggtgtggcccgtcagcccgcgtaccacagcgcccgggccgcgtcgagcccagtacagccaagccgctgcggccgggtccggcgcgggcggcgcgcgcagacggagggcggcggccgcggccagggcggcccgtgggaccgcgggcccccggcgcagcgctgcccggctcccggccctgccggcctcctcccttggcgccgcggccatggcggccagcgcgaagcggaagcaggaggagaagcacctgaagatgctgcgggacatgaccggcctcccgcacaaccgaaagtgcttcgactgcgaccagcgcggccccacctacgttaacatgacggtcggctccttcgtgtgtacctcctgctccggcagcctgcgaggattaaatccaccacacagggtgaaatctatctccatgacaacattcacacaacaggaaattgaattcttacaaaaacatggaaatgaagtctgtaaacagatttggctaggattatttgatgatagatcttcagcaattccagacttcagggatccacaaaaagtgaaagagtttctacaagaaaagtatgaaaagaaaagatggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcagctcagaattctgcaaatgcagattttgcaaactttgatgcatttggacagtctagtggttcgagtaattttggaggtttccccacagcaagtcactctccttttcagccccaaactacagcatttagaatgctttcatctagctgcagttttggtgaatttacttcagcttttcctcttcaggctacccacagtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggagctacgccttccacaaatccatttgttgctgctgctggtccttctgtggcatcttctacaaacccatttcagaccaatgccagaggagcaacagcggcaacctttggcactgcatccatgagcatgcccacaggattcggcactcctgctccctacagtcttcccaccagctttagtggcagctttcagcagcctgcctttccagcccaagcagctttccctcaacagacagctttttctcaacagcccaatggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacatctctccacctcttg

SEQ ID NO: 2692 - DNA, 1103 bp, Homo sapiens
tcccagcatcccctgcactcggttcctctgtaacttagactccagtgtgccgcgcagtgtgcgcaaattcacaaacccgcccgctgagttggtcgtttcggaatcccgagacttgaaacccaacgggaagacccttctcaccctcaaaagaagatgacagcccgcagagagttaacttctgtttacatggaactcagacatctgcaaatcatgatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagcttgcggaaggagctaatgctgcttatttgcagttgttgaacctgtttgcctatgggacatacccagattacatagccaacaaggagagcctgccagaactgagcacagctcagcagaacaagctgaagcatcttaccatcgtgagcttggcatcaagaatgaagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctc

SEQ ID NO: 2693 - DNA, 1937 bp, Homo sapiens
gagaccgctgcaagtcccggggccctgcctctatcgtcctaggggttccgcgggcaggagcaacccagaagcaccggtgaggccagcgcgtcctcgcagccatgagcagtgagcaggataaatcggccagcaaagaaaaatccaagaaaccagtaagatttctaccacagctgtctatggagaaattagccagcaaagaaaagttcaaggcaccagcaagagctttaccacagctgtctatggtgagtacaaagccccactggcagcaggcagctccatcattccatttgagtgtaaagcaggatgatgagagtccagaaccatttagtgttaaaaatgaacagtcccatgctgaatacatggaacgttttggaaaaaagggcaaattaccccaccaagttgatgatagttatgttggaccatctacttccaaatcaaagggcaaatctccacataaagaacgagaaaactttagaagtactcttgttaatgtcattatgcaacaagatgctgacttagactcagctgtccctgatggaagcacaattccaaaaccgaccgcttctgctatagagaaagacatcttgagatattactattatattcaccatggaattgatacagaccatgtagccccaatggaagattcttggctagaacacgtactggatttagttccacaacatctgaaagtcttcactgacagcatagttacattatctgatgaaatgagagaggattatcttcttagtgtaaggaaatccatagttgattttgttttaaaagatcctcgagagaaaggagatgataagaagacagatgaacttccagcccatcgtgctgaaatggaaattctgccaaaaccttggaggaaatcttttttagctgcaagcagttatattagggatcacttgaatgcaatgaaccccacaatgctggctgtactagatttgtggcacactaattttaaaaaattacgtttagttgatatcaaagaatttcataattgccaggatgcattagagctgtcaagttttcagaacattatcatgagacacatggactctgccaaagagactctacttaaaatgtggtttccagaagtgcagaatatttattaccaaggtaataaaaaaaagcaattgccaactggtgacagcagtgccaaattggaatcttttttcaactgtgctgctgcacttatgactttacagctgcaggacctcactttagtctccatgcaagatttcacggacttaattgcacaacccccagattctgttagagcttttgaacatccaggtttcatcatgaggctgattcttgataatgacaccattaagtttgaacctgagttgagtgactatatagatatctttctaaatgtttatgacgtcatgattaaagctgtcagttttgtgccaagagttgagacaaaattgtattccaagtggagaaacaaagcaaaaccaggacatttttacttttctcatattcaaaggtctgtcacctttcagcattctgaagtttcgtctcctcagaactctcattttaagattgtgtcacccttcagtgttcttggctttacatggagatgccaattatgacttccaactttgctcgaccttgaggctttgtttcctggcagcccctcccatgcatccaccttgccggaaactcattaaagcaaagcttagaccaccaaggatcagcagggtccccagggcagctgctcacttctgcacataatgacctttcaactcatgctttctctcattttggtcccttagacttttttttttgttgttatttccttagctatacgttataaaagataaagtcagctttattatcctggcatatttatgtgttttgaattgagtagttgttttctggatatctattcctcatactaccatgaatagaagtctctcaag

SEQ ID NO: 2694 - DNA, 3793 bp, Homo sapiens
gatgcctttaactctgccagggaactggcaagcaacaaagaaggtggtgattggctggattcttgctcatggctcctggcagatctgacaaatcctcttgcttttgctctaatctctgtctggatacttttaggaaaagaaccttgttattatgtactaaagtgaataatttgtgctcttagagtaggagttggaactataggacttgaaggcaagagcaggtatcttatcaaggatctactcactcagtttccctaaagctctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcaccaggcagctgaaattgaatggctgggatttcgaaaacctagccaagctgacatgttacattctaaacatgatgaggagcagaaggtttgggatgaagaaattgatgatgatgatgatgataattgcaataatgatgaagatgaagttcgagtgatagaatttaagaaaaaacatgaagaggtttctcaatttaaagaggaaggtgatgcaagtgaggactccccactgagcagtgccagttcccaagctgtgacacctgatgagcagccaaccttagggaagaagagtgatatctccagaaatgcttattccagatacaatacaatatcctatcggaaaatcagaaagggaaataccaagcaaagaattgatgaattcgagtctatgatgcatttataaactaactggaactgagaaattctcatgcccactaaaggaaaagctaattctattgccccagggtgcatatttctatgccttatttgagttatcacttggagggaggtggaagttgactctctttttcactgtagaataatgtggaaataaccctagataaaaattcagtctgataacctcaaatcaaaaagctttaaataaattcttgggcatttatcttttaaaacttcactaatatagcattgtgtgataagcactaagcagtcagtcccctgggggaatctggcataattcggctataaatgtagcaatgcttggaaaggtagtcatcaaatgagactatttgaggggactatttgaaatgattctggtatttcttttggtatctttcttcctgtacattggagtgatggaaagtctggtattaaaacctctcttacttttaaacttgattttgcagactctggcaataagccttccaaaattctgtgccttttctattatcaccaaacaatatgttaagtggctttccttggcatctacagagaaaacattctatagccctccttcctaggtgttaccattcactgaatcttctctcagagggagatgagcaattgtcagtcaggataattctgtttgctaaatgttgcctttatgctttcaaactgaattaaacccattgtgaggttgacactgggaggggctagaagattggtgggcagcagactaaagagttatgttggatagttttatttctgtggctgaaaataaaatcttgtctagcacagttaaagtcattaaaaataaaaatgacagctttagcacaattttaagaaaatgcccctctctattaccacattttctcttattaacagtatctcagaataattttctttccttagaaacctgagagaatgctagtcataactgtactagttactatgaaaatggaaataattatcttagaatattttcaaagtagagcgtgagcatgtatttttagtgggagagctctgatagttgttgggaatatataatttactggacctcagcccaaatcaagatgcttaaaattgtacttgtggagcttcactcaaaccaatgtgtcaaataacgtattgaatatttatgaaaagagagactatatttatattcttagatagtttgttccacaatttttcatttcatgcttccatatatattaccctgaactttctatcaccacagataaagattttgttttgccctgcaaataaaaagacaattccttattgtctgaatgtaatacagtcttcattgtactattcaaccctttgtttctttctttttcattttgtgaaaaactccatgttagtcctcttagatgactgcttatttatgtgtaacataaatcccacatattctaatgacaacttctttaatccttccgggtcatatattatatttccatagtatcacatactattatttagttgtttacaagactccaatttgaattcaggattacagtgctcctttcattctttcaaacagataacataaaagttctgttaccctcattctatacaacctatggatttcatgtgttacaatatcagtttccagaataaagtgagggaaatcaggtctttattgataaagttagggagaagattgatgcaataggacaatttccaatttaatttagatcctctaatctttctacatggacaagctgttttcttttctaggttactgataacccctacaattttcgacttaacttcaaaacacagtattgtgttatctatcacataacaggaccatgtttttaacctaccatcaagagcctgtattttgagttattccaacagagatgatggattcctgtagaactagaggtgggtgacctatggttatgtggcacggcaaagcaagtacctcttaagggactctaatatatgctaacgctggtcctcttagctctgtgctctcaccagacaatgaatgaactatgaaagatttagtcaacagaaactattttagggtatgtttagttggtaaatgcttcatgttcatggatgacacaatgtttttgcaaaaaaaccctgaaactattctttggcattggtgtccatggccctataccgccatcttacacgaaagccacagagttgaaagccacagagttgaaagccacagagttaagtgacctcaggtaacataatggtgatggttggccatttgagtctttgtaacctaggaaagacaaaggtctgattcagattgcatgggggatttttaacatatttgaaactcagggggaacatgattaagaacacaaactggtagctacacatgaaggtttacttgagcttttgtgattcaaagttcaggggtggtaaggactctggtaccagggaagagggagaattaatttattgtgcaaatgctggtatttcttacatgattttttgttttcctctgttgctagataaatagaaactaataatagctctatttctctgccaatataaaatctacctttcatataatgctacattgaaggcacagaatttgctaccatctctctctccccctacctaccaaactatccacaatttaaataaagaactgctgtgtctgacttactctcaataaaag

SEQ ID NO: 2695 - DNA, 1370 bp, Homo sapiens
tccagaggtgcgtggtcgtggcgcgagggatcctgaggctgctccagcagtgcgccgccgccgtctcctggggcggcttgggttagccgggagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcagggttgtgtgttggatttgacatagatgaagacgcattggaaatatttaataggaatgcagaagagtttgagttaacaaatattgacatggttcaatgtgatgtgtgcttattatctaacagaatgtccaagtcattcgatacagtaattatgaatcctccctttgggaccaaaaataataaagggacagatatggcttttctaaagactgctttggaaatggcaagaacagcagtatattccttacacaaatcctcaactagagaacatgttcaaaagaaagctgcagaatggaaaatcaagatagatattatagcagaacttcgatatgacctgccagcatcatacaagtttcacaaaaagaaatcagtaagtctcttgattttggctggtctacattcggtattgaaaagctttctgggccggatgtggtggttcatgcctgtaatcccagctactcgggaggctgaggcaagagaatcgcttgaactcaggaggcagaggttgcagtgagctgagattgccccactgaactccagcctgcgcgataagagtgagactcagtctcgaaaaagaaaaaaaaaggaaagctttgtgacaagtaattatttctagtgttaccaactttcctgtgtaaatatacaaagccagcctaggagacaccataaatggcctgtgggaaaggcccatcgtcaatagctaatattctagttctttcctaaatgctttgggtacaaaaagaaaaaaaaaatcaaaaactgtttttgctcttttcatatagtatatattttattagttagtttgtactaatacattctcatattacaaaggcaatttaatggaagaatcttccttttgatatttgaatcatctgaaataacacaaacagaacaatacattcaaagaaatctcatttgcataacaaaaagacaagttaaacaacaaaaaaatttttcctttctcacaggtggacattgaagtggacctaattcggttttccttttaaaagccc

SEQ ID NO: 2696 - DNA, 1075 bp, Homo sapiens
gacttccggtgctggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccaggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaa

SEQ ID NO: 2697 - DNA, 2135 bp, Homo sapiens
gtgtttcaccacacggagatgtggtcacgtgacttgtcaactttcacccaggatgtctcccttctgacttccccttagcaaccaagtcgcggcgcttggttccccagcaaccgggagacgcgtctgctgcgtggaaccgccgagttcccagcgcttgagaagggtcttcctatgttgcccgggctggtcttgaactcctgaactcaagcagtccttccacctcggcctcccaaagagctgggattacaggtgaaaattctggatctgttatctgtgaggaggccactccgttgacagttgtgtaaaactctgctgctttccccagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggaacatcctccgcatagacaacctctggcagtttgagaacttgaggaagctgcagctggacaataacatcattgagaagatcgagggcctggagaacctcgcacacctggtctggctggatctgtctttcaacaacattgagaccatcgaggggctggacacactggtgaacctggaggacctgagcttgttcaacaaccggatctccaagatcgactccctggacgccctcgtcaagctgcaggtgttgtcgctgggcaacaaccggattgacaacatgatgaacatcatctacctccggcggttcaagtgcctgcggacgctcagcctctctaggaaccctatctctgaggcagaggattacaagatgttcatctgtgcctaccttcctgacctcatgtacctggactaccggcgcattgatgaccacacaaaaaagcttgcggaggctaagcaccagtacagcatcgacgagctgaagcaccaggagaacctgatgcaggcccagctggaggacgagcaggcgcagcgggaggagctagagaagcacaagactgcgtttgtggaacacctgaatggctccttcctgtttgacagcatgtacgctgaggactcagagggcaacaatctgtcctacctgcctggtgtcggtgagctccttgagacctacaaggacaagtttgtcatcatctgcgtgaatatttttgagtatggcctgaaacagcaggagaagcggaaaacagagcttgacaccttcagtgaatgtgtccgtgaggccatccaggaaaaccaggagcagggcaaacgcaagattgccaaattcgaggagaagcacttgtcgagtttaagtgccattcgagaggagttggaactgcccaacattgagaagatgatcctagaatgcagtgctgacatcagtgagttgttcgatgcgctcatgacgctggagatgcagctggtggagcagctggaggagactataaacatgtttgaaaggaacattgttgacatggtaggactgtttatcgaaaatgtccaaagcctgatggctcagtgccgggacctggagaatcaccaccacgagaagctcctggagatctctatcagcaccctggagaagattgtcgagggcgacctggacgaggacctgcctaacgacctgcgcgcgggtcgtttccaaaagttcaattatgtggaggcttctggcactttctaagagaagcagttacaggtagaggttgaagtctgagatttcccctggaggtcttcttaaccttagagtctgtataatgagtactgtgggggtgttggaaccaccatttctgatcctgcacaatgccatccggtttgcaccagcacatccactgatgaatggtcacaaaatcagcagggtcggcctgaggaacctggctccatccctggggtctgcacgctaagaaggctctcccggatgtctgcgctgggtcccgcggcagcatgtctatgtctctggaaggagtgtgggcatcaagggcccagacagagatactatgttgtcagggcccagacagagatactatgttgtcagggcctgctttagtgcatgcatcattcactcc

SEQ ID NO: 2698 - DNA, 1883 bp, Homo sapiens
gttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaa

SEQ ID NO: 2699 - DNA, 991 bp, Homo sapiens
tcacctcttaacagaagcccaccctccatccctgacaccatgacccactgttgctccccttgctgtcagcctacctgctgcaggaccacctgctggcagcccaccactgtgaccacctgcagcagcacaccctgctgtcagccctcctgctgtgtttccagctgctgccagccttgctgccacccaacttgctgtcaaaacacctgctgtaggaccacctgctgccagcccatctgtgtgaccagctgctgccagccttcctgctgtagcacaccctgctgccagcccacatgctgtgggtccagctgtggtcagagcagctcctgtgcacctgtgtactgcagaagaacctgctaccaccccacaagtgtttgtctgcctggttgcctaaaccagagctgtggctccaactgctgccagccctgctgccgcccagcctgctgtgagaccacctgctgcaggaccacttgtttccagcccacctgtgtgtacagctgctgccagccttcttgctgctaatcaactcccaagagaactaccatcctcacacaacaaccttcagctcaactgacttgtcttttgagggactaatttactttgctgctgacagccaccatgctctcacccaaatttttatgaattctctacatgtttaaaatcttgggaatctgcttgagggagggcagaatacttcatcctcattccctctttccttacaccttgtggatcatgtgccagcttcgtctgttcttaatttggagtcatgatctcagctttgtctcaaaaatcaagagcttcattctttgcttctaaggaatttaggtttctgcaactgatcaatcatctttgcaattatattttcattttaaatatccttctcatggttcttgtatccttctttcttcttttcacgataactttgggttatgtctctggtagcagagattcttacctatatgtttctgaataaactctgaaccatcttcatctc

SEQ ID NO: 2700 - DNA, 3113 bp, Homo sapiens
ctctcggtcccatattgaactcgagttggaagaggcgagtccggtctcaaaatggagggccatgatccaaaggaaccagagcagttgagaaaactgtttattggtggtctgagctttgaaactacagatgatagtttacgagaacattttgagaaatggggcacactcacagattgtgtggtaatgagagacccccaaacaaaacgttccaggggctttggttttgtgacttattcttgtgttgaagaggtggatgcagcaatgtgtgctcgaccacacaaggttgatgggcgtgtagtggaaccaaagagagctgtttctagagaggattctgtaaagcctggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatgatcatgatacagttgataaaattgttgttcagaaataccacactattaatgggcataattgtgaagtgaaaaaggccctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattagtgggtaccttttttttcttatttaaagcacaagaggcccataaatcttgagttactttaaattcttttttttgatacaagttttcagagcaagagaataaaaatcatgtgttattaaacccctaactggctggcatgctttcctgtttgtattctatacattttgctggatgaaaccaaggatagttcaggtataattgtccaaaataacctaactgcagcagaaatgtagcacagttgcttagtacaggcttctcacttcctacagacctgaattcaaatttggatagtctgagttcttaaattcccaaagaacacactgttatttcttgtgtatatttcaacataaatcatgttgttaccaatttgtttggaaggccctggttgagaagagttttagttaataaggtcatatatacatatattaatataaaccaatgtctactgttttgctccagctagtgcttacagtttcattcgagccctgagtatgtgccctgctgttactctctttggtagttgaacgttgaattcaagtcttttgttttaagaagtactaagcaaacaagcaataaaaaggggaatggggtgtgctagtgtttgaatatgctctcttgttgctctaattctgtgcctctgtgcattaatatttggatgcatgcaatgccagcatggaaattggtcttcacacatactgcagttttccagaaacattcacaaaccaataaatgtaacagacattccatttgttaatgggcatatatgtgaaaagcagtgtagaaaataggctaatattagaaaatggttaagtcctaaataacttcaagtgtggttatataatggacactgtcaatgttcataacttaaacctgggtacctggtcaaaataatgcttgggaaacattaaaattgagctaaattgtctcaagttcttttattcatataaataaagtttaaaggaatgggggagattaa

SEQ ID NO: 2701 - DNA, 615 bp, Homo sapiens
gcgcgtggcgggcaggcggcaggaggcgggtgggtcaaggtaactctgggctacagagtccttgctgggggttcggggagcgcttggaccccggcttctgggacgcgtcaggtcgccgtgaagatgattgcatgagatcgtgcgtgtgaacgtttgttgacagctgttacttgagtccgacagccctgggggccgtgcatctgcgtaacatggctacctctgaactccttgggggacacgtatatctttgagaatccgatgaaaaccagagattccgcccttgttttcttagaattaaaattaccacagactgggtaatttataaagaaaagaagtttatttggctcacagttctggagactgggaagtccaagagcatggtgcaagtatctggagaagggagcactggctttgctttcatcaggccaaagatgcctttctttgggaatacgttcagtccgaagaagacacctcctcggaagtcggcatctctctccaacctgcattctttggatcgatcaacccgggaggtggagctgggcttggaatacggatccccgactatgaacctggcagggcaaagcctgaagtttgaaaatggccagtggatagcag

SEQ ID NO: 2702 - DNA, 1103 bp, Homo sapiens
cgcggctccagggccacgttccagggtcgggtttggtggattcctcagtccctgccgccgcggggcgccctgggatagcggcggggcctcctgaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatgga

SEQ ID NO: 2703 - DNA, 2031 bp, Homo sapiens
atgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccaggtcacgagcatgatttccgagttaagcacctgtccgaggccttgaacgacaagcacgggccgctggccgggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctga

SEQ ID NO: 2704 - DNA, 590 bp, Homo sapiens
agagatgtcttccaaggacaagggagaggggattatacaagagtgaggtgttgtccctgatatagacctgaatgggctcagccctagacacacttttaaagctctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcacc

SEQ ID NO: 2705 - DNA, 873 bp, Homo sapiens
gaggggagtggaggggaggcctcgcctggcccaccttcctcctgcccctctaccatgtggcccttcccgagccgctctctcttcccacccccgactcaggcctggctccagacggtctcctcagaccctgaggcccagggctggggggcctggaacgagaccaaggagattctggggccagagggtggggaagggaaggaggagaaagaggaggaagaggatgcagaggaagaccaggatggggatgcaggctttctgctgtctctgctggagcaagagaacctggctgagtgcccattgcctgaccaggagctggaggccatcaagatgaaggtgtgtgccatggagcaggccgaggggacgccacggcctccaggagtgcagcaacaggccgaggaagaggagggcaccgcggccgggcagctgctgagccctgagaccgtgggctgccccctctctgggacccccgaggagaaggtggaggctgaccacagatccgtctacgtgggcaacgtggactacgggggctccgccgaggagctggaggcccacttcagccgctgtggggaggtccaccgagtcacgatcctgtgtgacaagttctctggacaccccaaggggtgctgccgaaaagaaccaacttccctgggatcagctccacagaccgcgggggccttcgaggacacccaggctccaggggggcacccttcccccacagcggcctccagggcaggccccggctcagaccacaagggcagaaccgggcccgtggaaaattctcaccatggttttcaccgtattaaagggaagacccgattttgagagaggggctggggcctggatcaggagtaaaccacttgtgctccatcctgg

SEQ ID NO: 2706 - DNA, 3678 bp, Homo sapiens
gaggcggtggcggcggaggcggcaccgattgctgtgtcggccccagtgcggccgaagtcgcggtagagcgtagccccacgcccctcccccgtccgcgccctccctctttccctggggatggagaaggcgacggttccggtggcggcggcgacggctgcagaaggagaagggagccccccggcggtggcggctgtggcgggcccccccgcggcggcggaggtcggcggcggcgttggcggcagcagcagagctcgctcggcctcgtctcctcgtgggatggtgcgagtctgcgacctgctcctgaagaagaagccgccgcagcagcagcaccacaaggccaagcgtaaccggacttgccgaccccccagcagcagcgaaagcagcagcgacagcgacaacagcggcggcggtggaggcggcggtggaggcggaggtggcggcggcggcaccagcagtaacaacagcgaggaagaagaggacgacgacgacgaggaagaggaggtttctgaggtggagtctttcattttggatcaggatgatttggaaaatccaatgctggaaacagcttccaagttgctcttatcaggtactgctgatggtgcagacctcaggacagtagatccagaaacacaggctagactggaagctttactagaagctgcaggaataggaaaattgtccacggctgatggtaaagcctttgcagatcctgaagtacttcggaggttgacatcgtctgttagttgtgcgttggatgaagctgctgctgcacttacccgtatgagagctgaaagcacagcaaatgcagggcagtcggacaaccgcagtttggcagaagcctgttcagaaggagatgtaaatgctgtgcgaaagttactcattgaagggcgaagtgtaaatgaacacacagaggaaggggagagcctcctttgtttagcttgttctgctggatactatgagcttgcacaggttttgttggcaatgcatgcaaatgtggaagataggggaatcaaaggtgacattacacctttaatggctgctgctaatggaggacatgtcaaaattgtgaagttgctgctagctcataaagcagatgttaatgcacagtcttcaacaggcaatacagcacttacatatgcttgtgctggaggctatgtagatgttgtaaaggtgctcttggaatccggtgctagtattgaggaccataatgaaaatggtcatacccctcttatggaagctggaagtgctggacatgtggaagtagccagattgctgctagaaaatggggctggcattaatacgcattctaatgaatttaaagagagtgcccttaccttagcttgttacaaaggacacttagagatggtgcgatttcttttggaagcaggcgcggatcaagagcataaaacagatgaaatgcacactgctctgatggaggcttgcatggatggccatgttgaagtagctaggttacttcttgacagcggtgcccaagtgaacatgcctgctgattcatttgagtcaccattaactttggctgcatgtggtgggcatgtggaacttgcggctttacttattgaaagaggagctagcctggaagaggtcaatgatgaaggttatacaccattgatggaagcagctcgagaaggacatgaagaaatggtggcattacttcttggtcaaggagcaaatatcaatgcacagacagaagaaactcaagaaactgccttgactctggcttgctgtggaggctttctggaagtggcagactttctaattaaggcaggagccgatatagaactagggtgttctacccctttaatggaagctgctcaagagggtcatttggagttagttaaatacttattagctgcaggagctaacgttcatgcaacaacagcaacaggggatacagcactaacatatgcctgtgaaaatggtcatactgatgtagcagatgtcttacttcaggcaggcgcagatctggaacatgaatctgaaggtggaagaactcctttaatgaaagctgcaagagctggtcatgtttgtactgttcagttcttaattagtaaaggagcgaatgtgaatagaaccacagctaataatgaccatactgtactgtccctggcttgtgcagggggtcatctggcagtggtggaactacttttggctcatggggcagatcctactcaccgtttgaaagatggctcaactatgttgatagaagcagcaaaaggtggccatacaagtgttgtttgctatctcttggattatcctaataacttgctttcagcccctccaccagatgtcactcagttaactcccccatcccacgatttaaatagggctcctcgtgtaccagttcaagcactgcccatggttgttccacctcaggagcctgacaaaccacctgccaatgttgccaccactcttcccatcaggaataaagctgcttctaaacaaaagtccagcagccatttgccagcaaacagccaggatgtacagggttacatcaccaatcagtctccagagagcattgtagaagaggctcagggaaagttaacagaactggaacagaggataaaagaagccatagaaaagaatgcacagctgcagtccttggaactggctcatgctgaccaacttaccaaggagaagatcgaggagctcaacaaaacaagggaggaacaaattcagaagaaacaaaagattttggaggaactacagaaagtagaacgagagttacaactgaaaactcagcagcagctaaaaaagcagtatctagaggttaaagctcaaagaattcaacttcagcaacagcagcaacagtcttgccaacacctgggattactaactcctgttggagttggagagcagctttctgagggagactatgcacggttacagcaagtggatcctgttttacttaaagatgaaccccagcagactgctgctcagatgggttttgcgccaatccagcctctggcgatgcctcaagctttgcctctggcggcaggtcccttgcctccagggtccatcgcaaatcttacagaactgcaaggagtgatagttggacagccagtactgggccaagcacagttggcagggctggggcaaggaattctgacagaaacacaacaagggttaatggtagccagccctgctcagaccctcaatgacacgctggatgacatcatggcagcagtcagtggaagagcatctgcaatgtcaaacactcctacccacagtattgctgcatccatttcccaacctcagactccaactccaagtcctatcatctctccttcagccatgcttcctatctaccctgccattgatattgatgcacagactgagagtaatcatgacacggcactaacacttgcctgtgctggtggccacgaggaactggtacaaacactgctagagagaggagctagtatagagcaccgagacaagaaaggttttactccactcatcttggctgccacagctggtcatgttggtgttgtggaaatattgctggacaatggtgcagacattgaagcccagtctgaaagaaccaaggacacaccactctccttggcttgttctgggggaagacaggaggtggtggagctattgttagctcgaggggcaaataagagcacaggaatgtttctgattacacacctctaa

SEQ ID NO: 2707 - DNA, 2886 bp, Homo sapiens
ctgcagcttccccgggcgctgcctggacaggcctgcctgcgtgctgggacatgtctggcctccaaggaccgtcggtgggcgatggctgcaacggtggaggggccagagctggaggcagctgctgccgcaggagatgcttcagaggattcggacgcagggtccagggcgctgcctttcctgggcggcaaccggctgagcttggacctgtaccccgggggctgccagcagctgctgcacctgtgtgtccagcagcctctgcagctgctgcaggtggaattcttgcgtctgagcactcacgaggaccctcagctgctggaggccaccctggcccagctgcctcagagcctgtcctgcctccgctccctggtcctcaaaggagggcaacgccgggacacactgggtgcctgtctccggggtgccctgaccaacctgcccgctggtctgagtggcctggcccatctggcccacctggacctgagcttcaacagcctggagacactgccggcctgtgtcctgcagatgcgaggtctgggtgcgctcttgctgtctcacaactgcctctctgagctgcctgaggctctgggggccctccccgccctcaccttcctcacagtgacacacaaccgcctgcagacgctgcccccagcactgggggccctatccaccctgcagcgcctcgatctctctcagaatctgctggacacgctacctcctgagattggaggcctgggcagcctcctggagctcaacctggcctccaaccggctgcagagcctcccagcctctctggcgggacttcggtccttgcggctccttgtcctgcacagcaacctcctggcctctgtgccagctgacttggcccgccttccactcctcacccggctcgacctgagggacaaccagctccgggacctgccccctgagctgctagacgccccctttgtgcgcctgcaggggaaccccctgggtgaggcctcgccagacgccccgagttcaccagtggcagccctcattccagaaatgcccagactgttcctgacctcagatttggacagctttcctgtgacccctcaaggctgctcagtgaccctggcctgtggcgtccgcctgcagttcccagcgggagccaccgccacccccatcaccatccgctatcggctgctgctgccggagccaggcctcgtccccctgggtcctcatgacgccctgctcagccatgtgctggagctgcagccccatggggtggccttccagcaggatgtggggctgtggctgctcttcaccccaccgcaggcccggcgctgccgtgaagtggtggtcaggacccggaatgacaacagctggggtgacctggagacctacctggaggaagaggcaccccagcggctctgggctcactgccaggtgccccacttctcctggttccttgtggtttcccgccctgtgtccaatgcctgcctggtgccaccggaggggacactgctgtgctcctcgggtcatcctggggtcaaagtcatcttcccccctggggccactgaggagcctcgtcgagtctccatgcaggtggtgcgcatggctggccgagagctgcaggccctcctgggagaaccagaggctgcagtgagccccctgctgtgcctgtcacagagcggtccccccagcttcctccaaccggtcaccgtgcagctgcctctgccctctggcatcacaggcctcagtctggaccgctcccgcctgcacctgttgtactgggcccctcctgcagccacctgggatgacatcacagctcaggtggtcctggagctcacccacctgtacgcacgcttccaggtcacacacttctcctggtactggctctggtacaccaccaagaactgtgtgggaggcctggctcggaaggcctgggagcggctgcggctgcaccgtgtgaacctcatcgctctgcagcggcgccgggaccctgagcaggtcctgctgcagtgcctgccccgaaacaaggtggacgccacccttcggcggctgctggagcggtaccggggccccgagccctctgacacggtggagatgttcgagggcgaagagttctttgcggccttcgagcgcggcatcgacgtggatgctgaccgccctgactgtgtggagggcagaatctgctttgtcttctactcgcacctgaagaatgtgaaggaggtgtccttctaccgtggcgcggtgcctgtgcgggtgcccgaggaggctgaggctgcccggcagaggaagggcgcagacgccctgtggatggccactctgcccatcaagctgccgagacttcgagggtccgaggggccacggcggggggctggcctctccttggcacccttgaatctgggagatgccgagaccggctttctgacgcagagcaacctgctgagtgtggctgggcgtctgggtctggactggccagccgtggccctgcacctgggggtgtcctaccgggaggtgcagcgcatccggcacgagttccgggatgatctggatgagcagatccgtcacatgctcttctcctgggctgagcgccaggctgggcagccaggggctgtggggctcctggtgcaggccctggagcagagtgaccggcaggacgtggctgaagaggtgcgcgcagtcttggagctcggccgccgcaagtaccaggacagcatccgacgcatgggcttggcccccaaggaccccgctctgcctggctcctcggctccacagcccccagagcctgcccaggcctaggccccacagacttttaggctggcccagatattccccagtggatgggcagagcccccaccttcaagtctctccagtgtgtggggacgggtccctgtgagcaacaaaactgcactgtttctttca

SEQ ID NO: 2708 - DNA, 2390 bp, Homo sapiens
ttcgcggtgccaccgccccgcccacgcctcctcgccggcctccgagtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaaggtaaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagcattgtc

SEQ ID NO: 2709 - DNA, 1122 bp, Homo sapiens
gttggatgctctgctcgttgagtgaagaaaatccaccggcatcgcctgagccccgctaccgagaagggcgccgcttcctccggggagggggataaagatcccccgccgccggcccatgaggatattgccgtgaaaggcacagcgactgcagcaggaaccggacccggcaccggagcggcggcggcggcggcagcagcggtaccgcctcctcacccggcggcggcagcagcggcggcggcggcggcggcggcggcggcggcggcagcggtcccccctcctcacccgaacatcagggccctccagactcaggcgccccaacaaattcctagaggacctgtgcaacaacctcttgaggatcgaatcttcactcccgctgtctcagcagtctacagcacgaccccttatccctctggacagaatgcaggtccaaccacgctggtataccctcaaacccctcagacaatgaattcacaacctcaaacccgttctccgcccagcagaacagtgccaatacattgcacagacaactggaagaggaggaaggttttggaacagactcccgtttacaggtccttggctggaagaggctggataaaatactgcatttttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcag

SEQ ID NO: 2710 - DNA, 588 bp, Homo sapiens
gggatgctggggcgcgagcgggactgttgactaagcttcgttactgggccctggaagcgaggtgccaccgtacaggcagtacttctccaggcaagtagtattaaacaccagccgccctgggccaggcattgtactgtgggacccagtatgcattaagggaagaatccaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaag

SEQ ID NO: 2711 - DNA, 8047 bp, Homo sapiens
gacggcggctcggcgatggctctcccgcaggcgcagaaacggctgctgggcagctgatgggcaggagcttaccaggctggcttgctctgagctgcggttactgtgtccaggccccgggttctcagaactgtcatacataaagtacacagaaatgaagagaaaagtcgtgaatactcacaagctgagattgagtcctaatgaggaagccttcattttgaaggaagattatgaaagaaggcgaaaactaagattgctacaggttcgagaacaagaaagagatatcgccttacagataagagaagacataaaacagaggagaaatcaacaatttacacgtttggcagaggagctaagggcagaatgggaagaatcacaaactcagaaaatacagaacttggaaaaactgtatttggcaagtttaagaagtatgggagagggacatcgacaggccaaagaaaatgaacctgatttggatgctttggcacagcgggcagcagaaaggaaaagaaaagcagatttgaggcataaagaagccttgaaagtacagaaaaatcaaaaagaaatattactgaaacaaaaaacctggcatataaaagctcgaaaggaagcactgcttgtggaaaaagagagatcagccaaaattacaagtctgccacctcctcctccaactctttttgagaacatcgaagtaaaaagaatttctgcagtcaaaaccaatagttctacctaccatcatcttcacacttttgtgaatagagagacagacacaaaacggccagatgctcgtttggctgctgaagaggaagctaaacgattggaagaactacaaaaacaggcagcacaagagagaatggaacggtttgaaaaggcacatgtacggggattccaagcaatgaagaagatccatttggctcaaaatcaggagaaactaatgaaagaactcaaacagctacagcaagaggacctggcacgtaggagacagactgtagcacaaatgccaccacaactagttgaacttccatacaaacgcagtgaaatgaaagaagactggcagagagaattggaatttgcctttgaagatatgtacaatgcagacaggaaggtgaaagggaatctgattctgcaccttgaaccagagcccttgcccactgtgactaatcagatccaagatgaagagctggacctttcaatggaacaagaaaatttgggtgcagctgaagaccttccagtgacagaagctgaaatatgttctagtgaaacagatgttcccttggtaatgaagacccaacagattccttcaaaagttctttttaaaaaattattaaataagatccgaagccaaaaatctctctggacaattaaatctatgtctgaggatgaaagtgaaatgattacgactgttagtgaaattgagagtaaagcaccaacggttgagtcaggaacaattgccagcaaagagagaacgttatcctctgggcaggaacaagttgttgaaagtgatacactaacaattgagtctggaccacttgctagtgaagataaaccactttcgtgtggtacaaactctggaaaagaacaagaaataaatgagactctgcctatcacaactgtagctcagagttcagttctacttcatcctcaagaagcagcagccaggattagaatgtcagcaaggcagaaacagataatggaaatagaagagcagaagcaaaagcaattggaattacttgaacaaattgaacagcagaaattaagattagaaactgactgcttcagggctcagctggaagaagaaaaaagaaaaaaaactcaaccgactggggttggcattgctccagcatcatgccctgtaatttctgatgaagatagtcataggcagatgattcgtaactatcaacatcagcttttacaacaaaacaggttacacaggcagtctgttgaaacagccaggaaacaattacttgaatatcaaactatgttaaaaggaaggtgcccatcggtgtcagctccatcattgataactgattctgttatatcagtgccatcatggaaatctgagagaccgactgctatatcagagcattgggatcaaggtcagagactcaagttgagtcctaacaaataccaacccatacaacctatacagacctccaaattagaacaagatcattttcaggtagcgagacaaaatcactttccacaaagacaggtggaaacaacagaaacattacgcgcttcagatattttaaccaatcaagctttagaatcacaagaacatctaaggcaattctctcagactgaaacacaacagagagactataaattggtccccaaagattctgagacactttcaagggctttgtcacatgacaggcagctaatatcacaggatgctagaaaaatatctgaaacatttggggcaacaacttttcaaagtttagaatcccaacaattgttctcagagaatagtgaaaatatatcttaccatttaactgaaccttcttcatttgtaccactggtacctcagcattcttttagttctctgcctgttaaagttgagtcaggaaaaattcaagaacccttttcagccatgagcaaaagtacagtttccacaagccattctataatcagccaaatgcatgataggcctttgctgccgtcagagaatatcacagcccagcaaggtaatatgaaggccctccaagaacagttagacctacagaagaaagttcttcaggcaactcaggaagctcaggaacagttgcttttgtgcaaacagaaagaagtggaacagcaaacgggcctctcggtattccttcccttggtaactccagattcatctgctttattgccttctgccaaagcagatttggggagaatccaggaatcttcaccaaccaagaataatattgcagtttcctcagaccatcatgtgatctcacaacttcaggataagcgtttgagtctttcacagcctatcctatcacagcaaaataattttaaatttctccaagagcagttgaatattcagaaggatagccttcaggctaggcgagaagcccaggaagtattgtatgtacataaacagagtgaattggatagaagagtatgttccgaacaggctgagccctctttcccatttcaggtagctcagcatacatttacttcactaccatctgctgatacaaaatctggaaaaatacaggagcaacattcatctaagagcgagaaaggacttgtttcatgccaatctgacatccccatatctcaggatgggtctttgagtttcctacagcagttcctacctctacatgatagtttgaagttgctccaagaacagttgactaaacagagggatactcttcaggctaggcatgaagctcaggtggaattacttttacatagacaaagagatttgggggacagtaagtctgggctggtgagctcttcatcctcaccagtggttgttcagcattcagttgcttcacaagcttctgctaaagctgagcctaggagaattcaggagctttatttatctgagaaggagaatgtaggtccctcctgtcatttgataatcccaacatttcaggataagtctcttagttttccacagcatagcctggcacagcaagaaaatttgacaatactccaagaacagtcacaaatacaaagggtaatacttggtgctaaagaaggaactcaggaatttgtacacacagaaagtgaattggagaaaagaatttcttctgaacagactggcacctcctcatccctttcccaggtggatgaatctgagagattccaggaatgtatatcaatcaagagtgacagtaccattcccttaagccatcctaagatcccaagatgtcaggaaagacttttgagagtttcacaacatatgctacctctacaagataatttggaggaacaccaagcatggctagacactgagaaagaagcctttcatttcagccagaaaacccaagaaaatacatcttctgaacaaactggttcatcttcattcataccccagttggtacagctttcatttacttcgttagcttcagctgagtctggcacaatcctggaacctctttttacagagagtgaaagtaaaattttttcaagccaccttcagatcccacaattgcaggataggcttttgaggatatcgcaacttatccagcctcaacaagataatttgaaggcacttcaagaacagttagctacacagagagaagccatcattctagctagacaagaagctcgggaagaattacttttacatcagagtgaatgggagggaagaatatctcccgagcaggttgacacctcttccttacccctagtaccacagcattcattcgcctcattacctcttaatgaatctgaaagaaaccaagaaccatgttcaattaacagtgataatatagtatcctcaggtcactcagagataccaacattgcctgatgggctgttgggtttatcacatcttgttttacctcaacaagataatttgattgcacttgaagaacacttgcatgcacagacagatttccttccttctattgagaaaacccagaaagaattggttttgtcaaaaccatgtaaatttgaggaaaaggtatcttctgagcattttatccagtctcaccatggtgatttgcaggcacttcaacagcagttagatacacagaagaaagccattcgatctatacaggaagtccaagaagaattgcttttgcaaagattaagtgaattggagaaaagggtatcatctgaacaagtttgctcctcttcatttgtatcccaggtgcctgttgctgactctgaaagaacccagaagtctttcccaaccaaaagtaatgatactcttccctcaagtcatcgtgagattccaagattacaggatagacttttgagtttatcaaagcctattctgcctcagcaagataatatgacagcacaattggatgcacaaagggaagtgatgtattcttatgagaaaccccaggaagaactgtctttaaacaaacaaagaaagttgaacaaaagtgaatctgctgagcatactatcccctctttgtttctacccaaggaaacagagcattcgtttattccactaccttttgcagaagctaaacctaaaagcacttgtgaattgtattcatcccagaatgaacatgcagcccccccaagtaatcctgtgatcccagggtttcaagatagacttttgagtttttcacagtctgtcttaactcagcaagataacttgggacttcagaaacagttggatctacaaagagaagttctgcattatagccagaaagcccaggaaaaattgcttgtacagagacaaacagcattgcagcagcagatacagaaacatgaagagactttgaaggatttctttaaagacagtcagataagtaagcccacagttgaaaatgatttaaaaacccagaagatggggcagctcagagactggtttcctaatacacaagacctagcaggaaatgatcaagaaaatattaggcatgcagataggaacaactctgatgataatcatttggcttcagaagatactagtgccaagcaaagtggtgagcatctggagaaagatctggggagaagatcctcaaagccacctgtagcaaaagtcaaatgtggtttggacttaaaccagcatgaacttagtgctatacaagaagtagagtcaccagcaattggcagaacttctatactaggtaaaccaggtatttatgaagacagagaccccctgcgagtctcaataagccgagaacaaagtttctttgggagcccactggcccatgatccgtttagttgtcttcaactggttggccaagagaatgtctgtggtgatgactatgatgaagcagttaagctgaaggaatctgttgttgaaaatcatgcagtgttaagttatgctgtggaggaagaacatgcatatttgggtccaactgtgaagccagatgataaggctaaaacactgtcttatgaaccattatcttcagcaactgtttccactgggagccttttaagttatgaaaacacagatttgagccttacagatccagagtcattttcagagcacatggatgatagcaagcaagaatctaccaccagtaaagaagaggaaacaaatattataagttccatagttccttcaacacaagatatttatcagcggcagaactcttcagacgttcataaatctctgttgcctgcagtggatgaaactacatgtggtcacacacactttcagcaaatgatagacaagtacattaatgaagcaaatttgatacctgaaaaaacagatttgcaagaattggaacacatttttcctaatttgcatcatcagctgtttaaacccttagaaccacatccagattttgacttatcatcatcatcctctgggatttctccagacaacagagacttttaccagagatcagattcttcatctgaaagccactgtgctactggattatccaaaagtacagtttatttcacagcactgaggaggaccagcatgcattcttctcttaacacaagtccgaatcaacaacctgacactaacttggctcatgttggagctcacagttttgctacagaaaatattattgggggatctgaacaatgttttgaacagcttcagccagaatattcttcacaggaggagagccagcatgctgatctaccaagtatttttagcattgaagcaagagattcttcccaaggcatgaaaaatcagaactatccctctgaagaacatactgaaatattacaaaacaagaaaaaaattgttcatttccagctttctataggaaacttaagttcagtctacagttcatctgatgaagctaatgtatttgatcagttaaatgtacagcatagcactccatgtggttctaactctagtgagtgctcaacaaaacaccaactagaaagcagaaaggaaagtatgggctttgaagaactatcaaaaagaggggttgttacaatgttacaaagtcaaggactcattgaagataataaaaatgaaacctgtagggttttagacataaatccacaggtagaggaaactgactctcgattatgtgtaagaacagtggagatgggaacttcaattcaggcaccatattccttaactactcaaaatgaaaaatattttgagaattcagctgaaacagacattccaaaaatcaccaaaaaactatctcaactaggagaatcagagctttttgcaagttctggatcattttcattacagagctctataccagtctgggaaacagaaactggccatggtataatggaagaaccagaacttactttaataagcaccactgataccagtattgctgaaatggattttgcaaatttaaccctagaagagaagagcgagaatgaagcaaaatgcttctttcaggtgagtgagtttctgcctcttgtatcagcaacagaagcctcagattatccagctgtatcagaactttccatagaaaaaccaaggacagcatctacagcagaaacccctcgcaggcttacacctgtaccagggagcttacaagaagcatttataaagaggaaaaaatcatttatggagagatcccaccagaggcagaaagaaataaggaataaaattcatgtctctgaaaattctcaaatcaaaacagttaaagagaaaccatctataagttcatctgtgagtcgtctaaagggcgtgaataaagtcagagcatcttttcctgaagacagaaagactacacaggctctaaggcaccaaaggggtctaaggttatacaatcaactagctgaagtgaaacaacaaaaggaagaaaaaacaaaacaagaagcttatgcccaaaacagagcaagggcaaaagaattccataagaaaacactagagaaacttcgagccaaaaatacatgctgactttctagaaatagtgtaaaggttttttaattgtgtatatgtagcattagacaaaattatttaaagtcaataaattgttattcgagg

SEQ ID NO: 2712 - DNA, 1602 bp, Homo sapiens
tcagctccttcagtaggcaatgatatgggaaatgatgatgccattggagggaatgtgagcaaatatatagtgcttccaactggctattgtggacagcccaagaaaggacatcttatctttgatgcttgctttgaaagtggtaacctgggccgggtggaccaggtctctgagtttgagtatgatctgttcattaggccggacacctgtaatccacgcttccgagtctggttcaactttactgttgaaaatgtgaaagaatcacagagggtcattttcaacattgttaacttcagtaaaaccaagagtctctatagagatgggatggcccctatggtgaaatctaccagcagaccaaaatggcaaaggctgccacccaaaaatgtttactactaccgctgcccggaccataggaagaactatgtgatgtcctttgccttttgttttgaccgagaagaagatatttaccagtttgcttactgctacccatatacatacactcgcttccaacattaccttgacagcctgcaaaagagaaacatggattacttctttcgggagcagctgggccagagtgtgcaacaacgaaagcttgacctcctgacgataaccagccctgacaatctccgggaaggggcagagcagaaggtggtattcatcacaggacgagtccacccaggggaaacaccctcatcatttgtgtgccaagggatcattgacttccttgtaagccagcaccctattgcctgtgtcctccgggaatacctggtcttcaagatcgcaccaatgctcaatcctgatggagtctacctgggcaattacaggtgttctctgatgggatttgatctgaatcgtcactggctggatccctctccatgggtccatcctaccctgcatggagtgaaacaactcatcgtccagatgtacaacgacccaaaaacaagcctggagttttatattgacatccatgcccactccaccatgatgaatggcttcatgtatggcaacatctttgaggatgaggaacggttccagaggcaggccatttttcccaagctcctctgccagaatgctgaggacttctcctattccagcacatcctttaaccgggacgctgtgaaagcaggaactggccgtcgcttcctcggtggactcctggaccacacttcctattgctacaccctagaggtctccttctacagctacatcatcagtggcaccacggctgctgtgccctacactgaagaagcctatatgaagctggggcggaatgtggcaagaacctttttggactattatcggctgaaccccgtggttgaaaaggtggcaattcccatgccgagactgcgaaataaagaaatagaagtccagagaaggaaagaaaaatcccctccttacaagcacccactcctgcggggcccagccagcaactaccccaacagcaaaggggacaagaagagctcagtgaaccacaaagacccttcaaccccttttaagacacggagtcctgggaggtcttatggggacaggagcatgcattttctgctggggaatgaaattaatcactcttctctagcttccaaggatttgtggattaatgcatag

SEQ ID NO: 2713 - DNA, 1832 bp, Homo sapiens
tggttgcgcctgcgcagtgcatcaccgcaggcgggcctcgcgggtccgggagcgcggcggagacgatgcctgagatcagagtcacgcccttgggtgcctgccctgtgctgtcctggaacctggtccttccaccgggcagggggtcgagggcaccttccagcacagacaccaggacgggattccatgtcctcccccatggcgtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaag

SEQ ID NO: 2714 - DNA, 2253 bp, Homo sapiens
gacttttgtttttcagttgcgttccctgactcggagtcttagtgtgtcgttatttggacaagaggcacattgacccaatttggagacgtattttggaaggaggcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaacttgaatgtgatttgcagcagagggaggaagagattgctgaattgcagaaagctctaagtgatatgcaggtctgcctcttccaggaacgggaacatgttttacgcctctactcagaaaatgaccgactgagaatcagggagctagaagacaagaaaaagattcagaatctcttggctcttgtgggaacagatgctggagaagtgacctatttttgtaaggagcctcctcacaaagtcaccattctccaaaagactatccaggctgtaggtgaatgtgagcagagtgaatcttcagctttcaaagcagatcctaaaataagcaaaagaagaccatcgagagagagaaaagaaagttctgagcattaccaaagagacatacagacactcatcctacaggtggaagcactgcaggctcagctgggagagcagaccaaactttctcgagaacaaattgaagggctcatcgaggacagacggattcaccttgaggaaatacaagttcagcaccagagaaatcagaacaaaatcaaagagctaaccaaaaatcttcaccacacccaagaactgctctatgagagcaccaaagattttctgcaactcagatctgaaaaccaaaataaagagaagtcatggatgcttgaaaaagataatttgatgtcaaagattaagcaatatagggtgcagtgtaagaagaaagaagataaaattggaaaagtgttgcccgttatgcatgagagtcaccatgctcaaagtgaatatattaagtccctaaaagataagttagtacaagagaaaaagctgtccaatatgtaccaagagcagtgcatttccttagaagaagaacttgcccgaattcgtgaggaagagggaatgaggagagagatcttcaaggatcgcactaacaagatggggaagcgtttacagataatgacaaaacgctatgaggcattggagcgtcgacgtatcctggaagtagaaggctttaagacagatattaaagttctccgacagaaactgaaagacttggagcaaatgttgtataaggcaacagttaatgcccgggcaaaccaggatcttgcccttctgtgtgaggtccgtgacagcaatagacgggcacataagatacaaggagaactgaagaatcttaagtcgaaagtgtttggtctggagaatgaacttagactctgttaatgtctacttttggaaatggcccccatttagaagaggtgtgcttcttgaaacctgaggacaaggtcatctgctgccagaaaatgtaaacctgagttgactagagtggtggtattcattattgtaaagacagcttgaagaatcggggaccactaggaaagcttttcttgcatactcagcttgctttatcatttttgctgtccttttaacacttgcgaggagtaggggcctggtcctgaatgacttggaggctttcattatttatcctgtctgtattgaccggtttttgttttttcagaaggcagtgatgatgaaaacttaggaagaaggtattttgcaataagcttggctgagtgtccatgggaagaatactttccctaaagagagagaagcactcacagaggctgcctttctcctgagctcggggagaaggcagcacatcacaacctgtcacattgaaataggcgctcattctgctatttcaccttccgtcctgagcagagcctgaattacgtttttgggcaatttcatggtgtttcaccagagggcgctagagactcaaacgaaatgtccatctggaaagattcgggagacactttgccgaggggatgaagctgagatgatgcttgtatggaaagtttgatatttttatcagtcacatggcttttgaaaaatgatgtatatattttaaattaactattttcaataaaatatttcactcaaaa

SEQ ID NO: 2715 - DNA, 2506 bp, Homo sapiens
attagagaagaagcaggcagcttgagacaggtggagctggatcaagctgtgaacgtgatttgctggaagctggtcattagtgttagaaaccccgtcttatttatttcatccttcaccctaccatgattattgcaattattattatttatttttcatcttttttcaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttaccaa

SEQ ID NO: 2716 - DNA, 1090 bp, Homo sapiens
aacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttgggatgctcccatttcccagtagcctccaggcctgcaggttcccatgacccacagccgggccaccgaggacgggttttgggtccagcacgagctcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtaagtggcttctctggggagagtcctctggggggcaggacctctcgtcagccctgccagccacctgccaggcccagggctgccctgctttatgacgaggccatgtgaagcactgcgatgcagtcccccaggcccctgccacaaccctcagccaccctatagctgttgaatgggataccattcaccagggctgccagggagt

SEQ ID NO: 2717 - DNA, 1116 bp, Homo sapiens
ctcacctgctcctctacctgctccaccctcaatccaccagaaccatgggctgctgtggctgctccagaggctgtggctccggctgtgggggctgtggctccagctgtgggggttgtggctctggctgtgggggctgtggctccggccgtgggggctgtggctctggctgtgggggctgcagctccagctgtgggggatgtggctccagatgttatgtgcctgtctgctgctgcaagcccgtgtgctcctgggtgccagcctgttcctgcaccagctgtggctcctgtgggggctccaaggggggctgtggctcctgtgggggctccaaggggggctgtggctcctgtgggggttccaaggggggctgtggttcttgtggctgctcccagtccagctgttgtaagccctgttgctgctcctcaggctgtggatcatcctgctgccagtccagctgctgcaagccctgctgctgccagtccagctgctgtgtccccgtgtgctgccagtccagctgctgcaagccctgttgctgccagtccaactgttgtgtccctgtgtgctgccagtgtaagatctgaggctctggacccagaccttcaggtttctcctgtttggtgaaagcatttcttatggttccctgagtcagttcgtcccacacatcctccctgaggcacctgcacctgctctagctcaccatccatgcacacacctccttccatggctcagctctcctctgggccctgccttcagcctcctcactccagaaacgtgtgtttccctgatgcgggaggtgtcctcgcctggacgcaggcacccagccgactgccacgatgttccctgcacttgggtgtggaccatcttcttcttctccctgggctgactgagatgcaaggtctgaccccacaaggccaggccgacgtttctgagtgatcactaagaaccagcttctcaaccaccatcaggaccctggatcctcctgggccgctgcctgttctcctgtggcccaagtgtgaccaggaaggtctctttccttcctgttgtctccatctgtttaaaaaaaaataacaaaataatgaatgaatttccttgcaataaagcctctcatgtctgtaaatc

SEQ ID NO: 2718 - DNA, 682 bp, Homo sapiens
ctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccagctacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctc

SEQ ID NO: 2719 - DNA, 1213 bp, Homo sapiens
gggggagcgagccggtgctgctgcaggctgaggctgcggcagaggcggcgaggcgcgggcggtgaggacggacagtcaccgacttagtccagttccctgtgatctcaaaacaattgttgcagcaggctcctggcagtctcaagcagttcatcttcttggtgtactggtttcctattgtgattttatcatggaaaatcaattggctaaatcaactgaagaacgaacatttcagtaccaggattctcttccatcactgcctgttccttcacttgaagaatcattaaaaaaataccttgaatcagtgaaaccatttgcaaatcaagaagaatataagaaaactgaagaaatagttcaaaaatttcaaagtgggattggagaaaaattgcaccagaaattgcttgaaagagcaaaaggaaaaagaaattgggtatttgttgttataattgaataatgatgatgtttaaagaatgataaataaaaagtgcatagtttttatttttaaattattgctgtaaaaatttttacagttattattgttattttcataatccaaaagaaggaatgaatcacttaactttgggagttttcagtgggtggattcgggaacttgttaaaatgcagatttgctgggataagtgattctgattcacatggctggaatgaggcccagagattcttattttaacaatcacttcatgtggtttggctgcaggtaatctgtagaccatgctgaaggaaaacattttgtccaggtgactagcttgaaaaatcagaaacactaaaatagacatgtcacataggtggcatagaaatattttcgtagtacaatggagaaagggaatcattaaaaatcagagtggagaatggttatgtatattgtatatttcagttagataaattgaggaagctagtataataattattgaaggtctcaataattttccacaaaattctttaacttcttcagctcaaccatttctgtacttctctactatgaatcagaggatgaggttgtataattcaaaagcattgccttagtctagaaataattattgtacctatcatttagttttagaaataaaaagcaagctgattttttttgatgaaccatttatatctgtgatggaataataaaatttcacacttccggattcctttgttctcaattttgagccttgagttgttttaattaaagaggggtaaaggtaaagaa

SEQ ID NO: 2720 - DNA, 3848 bp, Homo sapiens
agacgcagaggcgaggccgccagtcgaggacgaggaggagataacatcaagatgccgaagactgaggaaactgtgctccagaatgatcccagtgtagcagagaatggggcccctgagcctaaaacaccagggcagagccagaaaagcaagagtttctgtttagatgaccagtctcctgacctgatgtcttttctgtcacagatctgatagagacagttaatgaagtttccaagctgagcatttcacatgaaattgtagtaaaccaagatttctatgtggaagagaccattttgcctccaaacagtgtagaaggcaggtttgcggaggcaatgtacaatgctttttggaaccatctgaaagaacagctattgagtactcctcctgacttcacttgtgcccttgaacttctaaaagatgttaaggagaccttgctatcactgctattaccatggcagaaccgcctaagaaatgagatagaagaagctctggacacagatctcctcaagcaggaagcagaacatggggccctggatgtccctcatctttctaactacattctcaatttgatggctctgctatgtgcaccggttcgagatgaagcgatacagaaactagagaccataagagatccagtgcagttactgaggggcatcctccgtgttctgggcctaatgaaaatggacatggtgaactataccatccagagctttcgaccctacctgcaggaacattccatccagtatgaacaagctaaattccaggaactccttgataaacagcccagtctcctcgattataccacaaaatggctaaccaaagcagccacagacatcactacactatgtccgagttctcctgactcacctagctcctcctgcagcatggcgtgttcacttccaagcggggcaggtaacaattcagagccccccagtccaacaatggtgctataccaaggctacctgaacctcctcctctgggatcttgaaaacgtagaattcccagagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttggagtctctgctacactttcctggaggcctcattctcattgaaaaggagttggcagaactgggctggaagtttctcaatctgatgcatcataatcagcagagtcatttttcacaaaacgaaatctttccagaagatcacgaataagagagatcaaagctaggcagcttgagttgaagtagagctggaagaaggagttttgaggactgtttcaaaaccactggactagatgatctctaaaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcggaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgtt

SEQ ID NO: 2721 - DNA, 4211 bp, Homo sapiens
agtctcttccccaactctccccacccctggtgctctccgccccgcttgcctcccgttcttccccgcccgctccatccgggtcgctgacggctgtctctggactggacagcagtggcgtccgcttttctctaaggaacccgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagagcaggttgttgccctggatgcccaaaatattgtagctgtttcatgtggagaagctcatacgttagcgctaaatgacaaaggccaggtgtatgcttggggtctcgattctgatggacagcttggcctggtaggatcagaggaatgcatcagagtacccagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatgataggtatgttcctaatttactaaagtcactaagatctcagaaaatagtttatatttgttgtggagaagatcatactgctgctctaaccaaggaaggtggagtgtttacttttggagctggagggtatggtcagttgggccataattctaccagtcatgaaataaacccaaggaaagtttttgaacttatgggaagcattgtcactgagattgcttgtggacggcagcacacttctgcttttgttccttcatcaggacgaatttactcttttgggcttggtggtaatgggcagctgggaaccggttcaacaagcaacaggaaaagcccctttactgtaaaaggaaattggtacccctataatgggcagtgtctaccagatattgattctgaagaatatttctgtgtaaaaagaattttctcagggggagatcaaagcttttcacattactctagtccccagaactgtgggccaccagatgacttcagatgtcccaatccgacaaagcagatctggacagtgaatgaagctctaattcagaaatggctgagctatccttctggaaggtttcctgtggagatagccaatgagatagatggaacgttttcttcctctggttgcctaaatggaagttttttagctgttagcaatgatgatcactatagaacaggtaccagattttcaggggttgatatgaatgctgctaggcttttattccacaaacttatacaacctgatcatccgcagatatctcagcaggtggcagctagtttggaaaagaatcttattcctaaactgactagctccttacctgatgttgaagcattgaggttttatcttactctaccagaatgtcccctgatgagtgattccaacaatttcacaacaatagcaattccctttggtacagctcttgtgaacctagaaaaggcaccactgaaagtacttgaaaactggtggtcagtacttgaacctccactattcctcaagatagtagaactttttaaggaagttgtggtacatcttttgaaactctacaagatcggtattcccccttctgaaagaagaattttcaacagttttcttcatactgcattaaaggttttagaaatactacatagggtaaatgagaaaatgggacagattatacagtatgataaattttatatacatgaagtacaagaattgatagacataagaaatgattatatcaactgggtccaacagcaggcctatggaatggatgtcaaccatggattaactgagttggcagatatccctgttacaatctgtacatatccatttgtatttgatgcccaagcaaaaactactctgttacagaccgatgcagtcttacagatgcagatggctattgatcaggcccacaggcagaatgtctcctctctttttctcccagtgattgaatctgtgaatccctgcttaattctagtggtgcgtagagaaaatattgtaggagatgcaatggaagtccttaggaaaacaaagaacatagattacaagaagccactcaaggttatatttgttggagaagatgctgtggatgcaggaggggtgcgcaaagaatttttcttgctcatcatgagggaattattggatcctaaatacggcatgtttaggtattatgaagattccaggctcatttggttttctgataagatcacagttgaaaactttggtgcaacagaagtgaaagagctggttctaaatggtgcagacacagctgttaacaaacaaaatcggcaagagtttgtcgatgcttatgtggattacatattcaataaatcagtggcttccttatttgatgcttttcatgcgggctttcataaggtctgtggaggaaaagtccttctgctctttcagcctaatgaactacaagcaatggtcattggaaatacaaattatgattggaaggaactggaaaagaatacagaatacaaaggggaatattgggcagaacatcctacgataaaaattttttgggaagtatttcacgaattaccattggaaaagaagaaacagtttctgttatttttgacaggtagtgatcgcattcctattcttggtatgaagagtctgaaactagtcatccagtccacaggaggtggtgaggagtatctcccagtttcccatacttgttttaatcttctggatcttccaaaatatacagaaaaagaaactctacgctctaaactgatccaagctattgatcacaatgaaggcttcagtttaatataactttggagttataactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctgataccagtacagtttctatggttgtaattgaacttgaacagacttttaaaggttaaaaattatgatttaaatcttactctgagactctataaaaagaaaaaaaaggtagcatggtggaaacactatcttttcttttttgctagaataagtgtctttgtgcaaacctaaatcacagatagggaatatactacataacctgcagttcttttctttgtgaatcctgacacactgatagatgggggattgtcgatcagagaacttattaatatttagtactggaagaactctgtctccacagttgccagtaataaaaagaaacattggctactatgagcaccaatcactgggttatagctttcaaaattattgatgctgcagtgctttagagctatttccttgaatttaagaaacaaatcttaacagttttatggtgctgatgcttagttgtctcatgccattaaattgtaaaagtgagttgatgcaatacatgtgactttctgctataatgcaaatatttattttttaaatttattttaaaatgccgtgaaaactgtttaataaagatttattgttttaatattt

SEQ ID NO: 2722 - DNA, 1566 bp, Homo sapiens
agccattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaacttag

SEQ ID NO: 2723 - DNA, 884 bp, Homo sapiens; identical to SEQ ID NO: 2530

SEQ ID NO: 2724 - DNA, 3220 bp, Homo sapiens
aactttgcctctcctttacgccaaatacgtgtccttatatctgaatctacaccactattatagattcaccttctttgagaagtccctatttgaagagaggaaaattcaggctacttgtaaccctcttattctttttagacggagttttccctcttgttgcccaggctagagtgcaatggcgcgatctcggctcaccgcaacctccgcctcccgggttcaagcgactctcctgcctcagcctcccgagtagctggaattacaggcatgcgccaccactcccggctaattttgtatttttagtagagacggggtttctccatattggtcaggctggtctcaaacccccggcctcagcctcaggtgatccgcccgcctcggcctcccaaactggtggggttacaggtgtgagccacggaacgcggctcctcttccttctggatatggctgtctcagatggccagaggcctcggaaaggcttccggtttcccggcaggcccgagtggggctgaacttccggcctcaggacgcaggcgcgggccgctcatttcgctctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagatttgtcgtctcattattgtaggagagaatttgtgggttgtggcagtaatacatttcccatgtgtcctgatgctttcaggatacatcagttgttagtgtttaaattgagttatttttattttgtgcttttgagatggagtctcactctgtctcccaggctggagtgcagtagcgtgatctcagttcgttgcatcctccgctgcccaggttcaagcagttctgcctcagccttccaagtagctgggattacaggcgtgtgccaccacactcagctaatttttgtattctcagtagagatgggttttaccatgttggccaggctggtctcgaactcctggcctcaagtgattcgcctgccttggcctcccaaaatgtgctaggattacaggcatgagccaccacgccccgcctaaattcaaaatctttttgtttttttttagacggagtctcactctgtcgcccaggttggagtgtactggcgcgatctcggctcactgcaagctccacctcccaggttcctgccattctcctgcctcagcctcccaagtagctgggactacaggcacccgccaccatgcccggccaattttttgtattttttagtagagatggggtttcaccgtgttagccaggatggtctcagatttcctgacctcgtgatctgcccatctctgcctcctaaagtactgggattacaggcgtgagccaccgtgcccagccctaaattgaattcttaaatccctcttgttcataaagcagtatatttggtttacagga

SEQ ID NO: 2725 - DNA, 1083 bp, Homo sapiens
ttcttaatggaatccaagcctctaagcctcacagtccaggccctccaccagcctgcctcaccctatcctcatttcatctcccgcaacctggctccgagtcagaggttccggttgagatcaagttgggagacacacccttgttcattctccttgagaagcagctattatcaacagaacattgacagaacctgtgtttggggaaaggactgatggctttgagtctaggttggaaagcacacaggaaccactgtggtctcctcttgcaggctctgcgaagcagtggtcttctcttgtttccctgtggccagtgtccctggagaggagctggaagctttttggaccctgagataaaggctttcctggaggagaacactgaagtcaccagcagtggtagcctcacccctgaaatccagttgcggcttttgacccccagatgcaaattctggtgggagagagctgacctgtggccccacagtgatccttactgggcaatctactggccaggaggccaagccctgtctaggtatcttttggataatcctgatgttgtcagaggaaaatctgtattagatcttgggagtggatgtggagctacagctattgctgctaagatgagtggggcatcaaggatcttggccaatgacatagaccctattgcaggaatggctattacactaaattgtgaattgaacagactgaatccttttcctattttaatccaaaacattttgaatttggaacaagataagtgggaccttgttgttcttggcgatatgttttatgatgaagaccttgcagatagtcttcatcagtggctgaagaagtgcttctggacctatagaactcgagtactgattggtgaccctgggcggccccagttcagtggacacagcattcagcatcacctgcacaaagtggtagaatattcacttttggagtctactaggcaggaaaacagtggactgacaacaagcacagtgtggggttttcagccttgagttgtcaaagtgcttccaagtatgaatatagtaatgtttggatctgactctaaaagttttctctataggagatactctccagttt

SEQ ID NO: 2726 - DNA, 2006 bp, Homo sapiens
ccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcacgaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaa

SEQ ID NO: 2727 - DNA, 1129 bp, Homo sapiens
aggcttgaaaaagaggtcaggccccaggagctgggctggagcagtgaggagtgtttcttccaagagaagatgactgcctgagaggattatttatgaggatggcctgtgcaaaaagacacccagagatttcatgctgttgattcacagaaagcctgttcctcttcactccgtagagtcctcagagtctggatcatcccttacagaagatccttgataatatttctgatatacctccaaggttccgtttgtcaaatgtgtgcgacccttctgataagtcaccagaggtgatgagggagagagagaaagaaagcaaattacaactgtaaagagtctctgaacagtgaaagatcaaaacagacagtctctggctttactggatgagtcaccattgcagcccgaccgcaaaaacaagcgtggcttctgtacttagcagcagtcttcctgtctggaaaggaaacattgctcagattggagatactggccattttatagacttcaaagcaacttaggccactgaactgtcaggcgggaaaacaggatgtcttccatttggaagcccctttgcttctaagaagttccagagaccatcccaggcccacagagttataaggattcatctgggcactgaagacatttgggacctcagtgaagtttctccgaggccagatggtcacattgattttctggaatcattttgaataaaaatgagcgaggtggtgaacacaatgcaaggctctccacgtactgtctggtattgttcaaccagctccacgactccctgagggcagagatgagcagatgttaatggataaagccaggctgaagaaatgtcaacaattgggagttttgaaggattccaggctgtgtctctgaagcaagagggagatgaccaaccctctgagactgaccacctatcgatggaggaagaggacccgatgccaagacagatttcaaggcagtcaagtgtgaccgaatcaactctttaccccaatccttatcatcagccttatatctcacggaagtactttgctacacggccgggggccattgagactgccatggaagacttgaaaggtcacgtagctgagacttctggagagaccattcaaggcttctggctcttgacaaa

SEQ ID NO: 2728 - DNA, 2067 bp, Homo sapiens
ctttcaaagccaatttgaataaacaactcttccctctcaaatgggcaagagtaactcttcagcaccatggagaggtccgggcagcgtgttacaacgtgggactgtgaccagggcaagcactctgacagtgattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaac

SEQ ID NO: 2729 - DNA, 1893 bp, Homo sapiens
agctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagc

SEQ ID NO: 2730 - DNA, 2081 bp, Homo sapiens
gaacacttcagcacctgtagcacagaagggccaaggagctgcagtcctcgaccagcaggaggtttgctcctcagcccactcgctgcatccagatcagctcacccctctcccttccctgcccaccaggactctgatagcccctggcagccacagcccattttgccaagatgtctagagtagccaaatatcgccggcaggtgagtgaagaccccgacatcgacagcctgctggagaccctgtctcccgaggagatggaggagctggagaaggagctggacgtggtggacccagacgggagtgttcccgtggggctgcggcagagaaaccagacggagaaacagtccacgggtgtgtacaaccgggaggccatgctcaacttctgtgaaaaggagaccaagaaacttatgcagagggagatgtccatggatgaaagcaagcaagtggagaccaagacagatgccaaggaggagaagatcatccggggcattgacaagggccgggtcagggctgcagtggataagaaggaggcagggaaggatgggagaggagaggagagggcagtggccaccaagaaggaagaggagaagaaagggagtgacaggaacacaggcttgagcagggacaaggataaaaagagagaggagatgaaggaggtggccaagaaagaggatgatgagaaggtaaaaggggagcgtaggaacacagacaccagaaaagagggtgagaagatgaaaagagcaggtgggaacacagacatgaaaaaggaggatgagaaggtaaaaagaggaactgggaacacagacaccaaaaaggacgatgaaaaagtcaagaagaatgaacccttacatgaaaaggaagccaaggatgacagcaagaccaaaacacccgagaaacagacgcccagtggccccaccaagccctctgaaggaccggccaaggtggaggaggaggcagctcccagcatatttgatgagcctctggagagagtgaagaacaatgaccccgagatgactgaggtgaacgtcaacaactcagactgcatcacaaatgagatcttggtccggtttactgaggctctggagttcaacactgtggttaagctgttcgccttggccaacacgcgagccgatgaccacgtggcctttgccattgccatcatgctcaaggccaacaagaccatcaccagcctcaacctggactccaaccacatcacaggcaaaggcatcctggccatcttccgggccctcctccagaacaacacgctgaccgagctccgcttccacaaccagcgacacatctgtggaggcaagacggagatggagatcgccaagctgctgaaggagaatactaccctgctcaagctgggctaccattttgagctggccgggccccgaatgactgtcaccaatctgctcagccgcaacatggacaagcagagacaaaagcggctgcaggagcaaaggcaggcacaggaagccaagggagagaagaaggatctgctggaggtacccaaggccggggccgtggctaagggctccccaaaaccttcacctcaaccatctccaaagccctctccaaagaactcacccaaaaaagggggtgctccagctgccccaccaccccctccccctcccttggctccaccccttatcatggagaacctgaagaattcactctcaccagctacccagaggaagatgggagacaaagtcctccctgcccaggagaagaactcccgtgaccagctattggctgccatccgctccagcaacctcaagcagctcaagaaggtggaagtgcccaaactgcttcagtaggaccaggctgccaggcaccatctgccaatgccatgactgctcaggcctcacctcccagggctacacagaccctgcccaccccatccctggctgacctgctgtggatgtccctattctgccatgggagagtccaggcctgggtcacgctcaaggaaggatgccttatctcttctcactttccttttcttgtctctgaggctctccaaattttgctttagtacatggagctcaggtttctggacaagaagagtccttttagcacat

SEQ ID NO: 2731 - DNA, 339 bp, Homo sapiens
gtgacctcgaggcagcctcagcacggcactctcttgggtcctcttccaggctcacactgggcgacagcggagaggctcttggacggggcagagctcgcgccgagacctgcatgtccgcgtcttgtgacgggtgtgtgggaagccgcccgcctgtgcatcttgcttccgggtattcgctggctgatttactggttttagagatggggatgggcacccagtgctggactgaagaccagagaaggtggagctccctgtggccttggtctcacctctcttcagacccaagcctgcccaatgtgcaggtgaccaggctgacactcctgtcggaacaggctccgg

SEQ ID NO: 2732 - DNA, 1884 bp, Homo sapiens
gctgaggacggggcggggcctcgcgctaacggtcgcgcggccgtcgcacctgcacgaggctgtggcccgagcgtcctgtggagaagccgcgaagcgcgggcgacccgggggtcgggcgggccaggtccgcgaggccgcggcggcagctgtgcaggcccggggagcagccggccgggcgagcctcggattaaaaaaatggcaaactcctttgcagcgaggattttcactaccctttcagatctgcagacaaatatggctaatctgaaagttatcggtatagttattgggaaaacagatgtcaaaggctttccagacagaaaaaatattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggttggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagatataccagaagctaacattctgctgaattttatacgagaaaataaagaaacgaatgttctggatgatgaaattgacagttatttcaaagaatccataaatttaagtacaatagttgatgtctacacagttgaacaattaaagggaaaagctttgaagaatgaaggaaaagctgatccttcctatggcatcctttatgcctacatttccacactcaacattgatgatgaaactacaaaagtagttcgaaatagatgttccagctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctgcacggtacatgagtttcttgcaatgacagatgaacagaaaacagcattaaagtggcaatttctcttggaaagaagcaaaatttatttaaaattcgttctatcacacagagcaaggagtggattgaaaattagtgtactctcgtgcaagcttgcagatcctactgaggcaagcagaaacttgtctggacaaaaacatgtttaaaacggtctatcattttgaactctggaaaagtataagagttttaactccctttaaaatggaatattaatttgaaaattatggggaaaattgcattttgtttacatgtggtgaacatgtttctagaaattgttatggtggaggtggtctgggtgagtctgaaggcctctctcatctgacctcccttcttagaaggcctcctactgtctttgccttgtctcctcccaagttggaaaatgtttacatgaattaataaacagatttaatcttctacag

SEQ ID NO: 2733 - DNA, 1124 bp, Homo sapiens
acggggcggggacgagctgtcgcgctggttgctcgtgcaggagcgggacccggaacagaccgccgtgagagaggaggggtgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagc

SEQ ID NO: 2734 - DNA, 3636 bp, Homo sapiens
cggcaactccacccggcgctgaccccctcaactctgcaggacccggcgcgcgaggaccccacgacccgcgggcgcctgcgcggaccccgcgagccccggcgcctgcgcgagtccccgacgccgcccccgcccccactcaccgggccccgcagcaggggccggagccgccggcggcggggcgggggggggcgccccgatgagccccgagtgcgaggagccgccgccccccctcgcagggcgccatgttttggaagtttgacctgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtaccccagtgtggcctgcgagattctgacctcagatgtgccccagatcaatgatgccctgggtgctgatgagtcccttctgaaccggctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattggcacctcggccatcatggacctcctgctgcgcctgctcacctgtgtggagcggcctcagctgaggcaggatgttgtcaattggctcaacgaggagaagatcgtccagcggctgattgagcagatccacccgtcgaaggatgagaatcaacattccaacgcatcccagtccctgtgtgacatcatccgcctgagccgggagcagatgatccaagtccaggacagcccagagcctgaccaactgctggccaccctggagaagcaggagacgattgagcagctcttaagcaacatgttcgagggggagcagagccagtctgtcatcgtcagtgggatccaggtgctgctgaccctgctggagcccaggaggccgaggtccgagtccgtgaccgtgaacagcttcttcagcagtgtggatgggcagctggagctcctggcccagggggccctggaaagcactgtgtccagtgtgggcgccttgcacgccctacgcccgcggctcagctgcttccaccagctcctgctggagcctcccaagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggacctcttcttccattatgtcttcaacaacttcttgcatgcccaagtagagggatgcgtgagcaccatgctgagcttggggccacctcctgacagcagccctgagacgcccatccaaaaccctgttgtgaaacatctgctgcagcagtgccgcctggtggagcggatcctgacgtcctgggaggagaacgaccgtgtacagtgtgcgggaggccctcggaaaggctacatgggtcacctgacaagagtggccggtgccctggtgcagaacacggagaaggggcccaatgcagagcagctgcggcagctgctgaaggagctgcccagcgagcagcaggagcagtgggaagccttcgtatcggggcccctggcggagaccaacaagaagaacatggtggacctggtgaacacccaccacctacactcctccagtgacgatgaggacgaccggctcaaggagttcaacttccctgaggaggctgtgctgcagcaggccttcatggacttccagatgcagcgcatgacctctgccttcattgaccacttcggcttcaatgatgaggagtttggggagcaggaggagagtgtgaacgcaccttttgacaagacagccaacatcaccttctccctcaatgctgacgatgagaaccccaacgccaacctacttgagatatgctacaaggaccgcatccagcagtttgatgatgatgaggaagaggaggacgaggaagaggcccagggctcaggggagtctgatggagaagatggcgcctggcagggcagccagctggccaggggggcccgtctgggccagccacctggtgtccggagtggaggcagcacagacagtgaggacgaagaagaggaggacgaggaggaggaggaagacgaggagggcattggctgtgcagcccgtggaggggccacccctctgtcctaccccagccctggccctcagcctccaggccccagctggacagccacctttgacccagtgcctacagatgccccgaccagcccccgagtctccggggaggaagagctgcacactgggcctccagccccacaggggcccctcagtgtgccccagggcctccccactcagagcctggccagccctcctgcccgtgacgccctgcagctcaggtctcaggaccccacacccccctcagcacctcaggaagccacagaaggcagcaaagtcacggagccctcagccccttgccaggccttggttagcatcggggaccttcaggccaccttccacgggatccgttctgcccccagctcctcggacagtgcaaccagagacccctctacctctgtcccagcctccggggcccaccagcccccccagaccacagaaggggagaagagcccagagcccttggggcttccccaaagccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacg

SEQ ID NO: 2735 - DNA, 1851 bp, Homo sapiens
gaaaagccgccggtatttctccacctggctctcctctacctccaggcaggcgcacccgaggtccccctcccaccccaccttctgccctcccgcacacttggaccagtgctgttgacccggaagcggacatttctgcagctattctaagcacacgtcggcggagggagcgggacgtggccagcggtcagcggcgaaggaggcaggccctgcgcggggatcacggaagccctgtgattcaccatgaagttccagtacaaggaggtccatccctttgagtatcggaaaaaggaaggagaaaagatccggaagaaatatccggacagggtccccttgattgtagagaaggctccaaaagcaagggtgcctgatctggacaggaggaagtacctagtgccctccgaccttaccgatggccagttctaccttttaatccggaagagaatccacctgagacctgaggacgccttattcttctttgtcaacaacactatccctcccactagtgctaccatgggccaactatatgaggacagtcatgaggaagatgattttctgtatgtggcctacagtaatgagagtgtctatgggaaatgagtggttggaagcccagcagatggaagcacctggacttaggggtaggggaggggtgtgtgtgtgacttggggaaagagagggcggctcccaccgtgaggagacagaaggtgaagacatatagaaactttacaccgcacacaccgtcaacgcattttcacatgctcaactgatattttttgttgcttccttggcccagggagaaagcatgtcaggacagagctgttggattggctttgatagaggaatggggatgatgtaattttatggcattcctgagatttaatttttgtgcagtttcatagaaaggtcggtcaggaggtggacaagttggggtcagagatgatggcagtccagcagcaactccctgtgctcccttctctttgggcagagattctgtttttgacagttgcacaagacaggtagggaaaggggacttgtggtagtgggccatacctggggacgaaaagagacccactgtaattgatgcatcgtggcccccgatcttccgtatcccacacttcttttctcccatcccagttgcaatctcactcacaaacatcacagtaccaccccaggggcggcagtagacaccaacccagaaatttagacagggatctcttatctttggaaaataggggttaggcatgagggtggttatgattaagaagataattttgttgttaaatagcattaaactggaattgacagagtgagttgagcatctctgtctaacctgctctttctctctggtgctcctcatctcacccctaccttggaatttaataagcttcaggcatttccaattgcagactaaaaccacttctaccatctcctctagtattttccatgtatcaggacagagatgtcttatgtagggaaggggcaggtatgaagtgaggtagattatctatacctctcactcattcaggattctcgctcccatgctgctgtcccttcattctcacactcacaggaatgctatgtgatggccagctgcttcccttcttggttatccactgcagctgctagttagaaaggtttgcagggatgacttttagtaaatcatggggattttattgatttattatcacttataggattttgtggggtgggagtggggagcaggaattgcactcagacatgacatttcaattcatctctgcaaatgaaaagggttcttcctcttgggggaaatctgtgtgtcagttctgtcagctgcaagttcttgtgtaatgaagtcaatgctgtcaggccaag

SEQ ID NO: 2736 - DNA, 1594 bp, Homo sapiens
gtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgaccacccccacctacggggacctcaaccacctggtgtcggccaccatgagcggggtcaccacctgcctgcgcttcccgggccagctgaacgccgacctgcgcaagctggccgtcaacatggttccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactccccgctgaccctaacaatacctttggagctcgctttacctctggctacttcatctccgaccctggctcccctttgagccctaatttatctttaacccccttgagctcttccaaccttgacattcccaggaggagccccgcttcaccccttctgactctggaaaccgcacctttaactttgcagaccttccttcacccctgacttctgcttcacctttgacctctgccccccatgaatcccattttacctctagacctataagttctggtttatgtttgacccctccctctgagctgcactt

SEQ ID NO: 2737 - DNA, 877 bp, Homo sapiens
gcacagcagtgacgacacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctg

SEQ ID NO: 2738 - DNA, 3007 bp, Homo sapiens
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtgtggatggccagggtacctggggactcaggctgctgccagttctgctcaccaccatccgtgcttggcacagaagtagctgcatagaaagggcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaatagtgaccatgttttattttcttgttcttgtcactattgtattttattttgcataatcatgcccttcactgacagtctccttaacatcatctgtttactctgctcagtgtaaactacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattagagattgaattgctttccctgggagtgtgcagtatctcattaaaatgttgtatattcaaaaaaatacagacacacacaagtgcctatataatgataaaacatatccaaagcacccaaacctgtgattccagaaaagtagatcctatttttgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 2739 - DNA, 592 bp, Homo sapiens
tattttgggggtggttggaggcggtggcggcggcggcgaggaggggaatttccttgtgcctccattcccgggaggggggagcggcgttggaggccaccgtttccagcatcaacaacagcaacttgtgattggcggtgaccggatattcagttgcacatccccacatcaatgcactgccaatgatgaggaaactgaggccttggactagaacagaggtctcctgactcagtccaggactctttctattacatcatgcggcctgatatttgtctttatggaactcagcaacatcacatacaggtagagacggggtttcaccgtgttagccaggatggtctcaatctcctgacctcgtgatctgtccgccttggcctcccaaaggtttgggattacagacgtgagccaccgcacccagccgatattgttttattttaatcaaggcaaaactggttatatcctgtgttgtgacctcatggtttaagtgggaataaagatgagtataagcagtgatgaggtcaacttcttggtatatagatacttgcaagagtcaggattttctcattcagcatttacctttggtatagaaagccat

SEQ ID NO: 2740 - DNA, 1504 bp, Homo sapiens
gtgtcctccggtcccctctgcctcaggcagctgcatgtttgcctctgacctcctcagggctttagattgctgccctggggcgggaagctccggcctcctcccccagctgggcccccgacagctcctggcattcacagtgaactgtctggggaatcatcgctatttggggttcttcgaggacctggagcagcggcacaaggcccaggtgctggtcgaggacatcagtgacatcctggaggagcacgctgagaagcacttccacccctacatcgcctactgctccaacgaggtctaccaacagcgcacgctgcagaagctgataagcagcaacgccgccttccgagaggccctgagagagattgagaggcggccggcgtgcgggggcctgcccatgctctccttcctgatcctccccatgcagcgggtgacccggctgcccctcctgatggatacgctctgcctcaagacccagggccactccgaaaggtacaaggctgccagccgtgcactgaaggccatcagcaagctggtgaggcagtgcaacgagggggcccacaggatggagcgcatggagcagatgtacacgctgcacacacagctggacttcagcaaggtcaagtccctcccactgatctctgcctcccggtggctgctgaagcgcggagagctgttcttagtggaagaaaccggactttttcgaaaaattgccagccggccaacgtgctaccttttcctgttcaacgatgtcctggttgtgaccaagaagaagagcgaggagagctacatggtccaggactacgcccagatgaaccacatccaggtggagaagatagagccgtctgagctccctctgcccgggggcggcaaccgtagctcctccgtgccccaccccttccaggtgaccctgcttcgcaacagcgagggccgccaggagcagctcctgctctcctcggactccgcgagtgaccgggcacggtggatcgtggcgctcacacacagtgagagacagtggcagggcctctccagcaaaggagacctgccccaggtggagatcaccaaggccttcttcgcgaagcaagcagacgaggtcacactgcagcaggcggacgtggtcctggttctgcagcaggaggatgggtggctctatggcgagaggctccgggacggagagacgggatggttccccgaggactttgcccgcttcatcaccagccgtgtggccgtggagggcaatgtccgcaggatggagcgtctgcgggtggagacggacgtgtagccctggcgaggccagccggcggcagcacagcctgtctccaatcagcaagtggtcgtgcctggctctagagagcgtggggagctggtctcaaggacccagcatggttccctggggcttcccaagagcctgtggctgtggtgccgggctccagacacttcacggaaggaagatcacatgtccccagagaggcacccccaggcaagctcgagggggccacaccgtgtccca

SEQ ID NO: 2741 - DNA, 2776 bp, Homo sapiens
ggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagcctgtaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagtgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgt

SEQ ID NO: 2742 - DNA, 2671 bp, Homo sapiens
atgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagagtttgctgcaacagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaaga

SEQ ID NO: 2743 - DNA, 689 bp, Homo sapiens
ggagaaggggcgcaggtggccgccatcttggattgcgaactgggtcgctacgcttcacgccaggggcggagtggcggcccttctgttacccgccacacacgtcgccgctggggactgggaaatcagggcatcggagagtgccacattaatgggtctctggaacctggcggtgccgggtgtttctcgtgttttccccagggcgacagcggtcgcgggggcgtggcagccggacctttcccttgcggacgcgaaggcgtgatgccatggctagtccagggaaagataactatagaatgaaaagttataagaataaagccctaaatcctcaagagatgcgtagacgaagagaagaagaaggaatacagcttagaaaacaaaaaagagaagaacagttgttcaaacgcagaaatgtctatttgcccagaaatgatgaatctatgcttgaaagtcctatacaggatccagatattagttccactgtacccattccagaggaagaagttgttactacagatatggttcagatgattttttctaataatgctgatcaacagctaacagcaacacagaaatttagaaagctgctttctaaagaacctaatccaccaatagatcaagttatacagaaaccaggagttgtacagagatttgtgaaatttcttgaaagaaatgaaaattgcactttacaa

SEQ ID NO: 2744 - DNA, 550 bp, Homo sapiens
gattattgcaattattattatttatttttcatcttttttcaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggaatcaattcatttacagctttccagtttttccag

SEQ ID NO: 2745 - DNA, 2702 bp, Homo sapiens
ggtttcaaattggccctttggcctctggagcaaattcaaatgtaactcttccccaaccccccttctcttcttccagattaattaaaagaagaatgaactataatccttgaagataactgggcaattttttaagtcggaggctgttcttactggtgtgaggatttacacacgtcttcagtttttcagcacagaccagcagaccatcatttttagaggaaatactccctctgccctcctttttggtttccttggtggtaaagattaaatttggttgcatcattttgacttgtgtttgagtctagattttatggcacaaggaatggcataaacttttcatgtgttttggttaaaacaaaccagaccattgcattgaccctggacatctttaattgagaaattggtaactttattttaatatgtatatctgaagaattcaagaaaacaaaggcatcctcagaggtgtgcctcttttctttattattagaggcaaaacgaacaattttataggatttgtagtgaaattataccagattataaggagaaccaaaactaagtcgcaaaatttattaatttaaggggctctcgctttgaaagtttgagagtaagttacgataggcatttgtatccattcattactttcctcttttcaaataagcaactaaatagaaatgctaatctcagacttaattatttaacagaagagtgtaccatggaaaacctccagacaaatttctccttggttcagggctcaactaaaaaactgaatgggatgggagatgatggcagccccccagcgaaaaaaatgataacggacattcatgcaaatggaaaaacgataaacaaggtgccaacagttaagaaggaacacttggatgactatggagaagcaccagtggaaactgatggagagcatgttaagcgaacctgtacttctgttcctgaaactttgcatttaaatcccagtttgaaacacacattggcacaattccatttaagtagtcagagctcgctgggtggaccagcagcattttctgctcggcattcccaagaaagcatgtcgcctactgtatttctgcctcttccatcacctcaggttcttcctggcccattgctcatcccttcagatagctccacagaactcactcagactgtgttggaaggggaatctatttcttgttttcaagttggaggagaaaagagactctgtttgccccaagtcttaaattctgttctccgagaatttacactccagcaaataaatacagtgtgtgatgaactgtacatatattgttcaaggtgtacttcagaccagcttcatatcttaaaggtactgggcatacttccattcaatgccccatcctgtgggctgattacattaactgatgcacaaagattatgtaatgctttattgcggccacgaacttttcctcaaaatggtagcgtacttcctgctaaaagctcattggcccagttaaaggaaactggcagtgcctttgaagtggagcatgaatgcctaggcaaatgtcagggtttatttgcaccccagttttatgttcagcctgatgctccgtgtattcaatgtctggagtgttgtggaatgtttgcaccccagacgtttgtgatgcattctcacagatcacctgacaaaagaacttgccactggggctttgaatcagctaaatggcattgctatcttcatgtgaaccaaaaatacttaggaacacctgaagaaaagaaactgaagataattttagaagaaatgaaggagaagtttagcatgagaagtggaaagagaaatcaatccaagacagatgcaccatcaggaatggaattacagtcatggtatcctgttataaagcaggaaggtgaccatgtttctcagacacattcatttttacaccccagctactacttatacatgtgtgataaagtggttgccccaaatgtgtcacttacttctgctgtatcccagtctaaagagctcacaaagacagaggcaaatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatagaaactgttaaagagattcatctgtgtattactgacaaggttttttttgtttgttgcttgctttggtaattgaattc

SEQ ID NO: 2746 - DNA, 4012 bp, Homo sapiens
acggcacccgccagtgggggtgcctcaacttccgcgggcgtttaaatagcagcctctctcccctcccaccggtaataggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtgagcattggcagcccagagaagatggagcccatcaccaaggtgtcacacattcccagcagccggtgggcgctagtgtgcagcctctgcaatgagaagtttggggcctctatacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggtaatgattgacactgacaccttatagtgacttagagaagaagatgcaaagaggcgaacgctcgcccagagcaagaaatgatagccagtcatatactctcagacccttgtacacaccacagcatgaggttgtgttggttaaaaatatttatgggctggtaaactcattgtacatatgtgcaaaactgctactgagtggggagcttctttgtggtttttttttttttaaaaacactttcccattaatctttactgttttgtaagatcaaatggggtgtgtcttccccacccccattccttcattctagagctagagtgaatgagccccaagaaaatgacccaaggagttgactcaggatggtttacagactgatttagaaaaccagaacggatttcatttctaatggagggggccagagatgggaaaatttcttgttcagtccggggaaacacacctaggtgctggtgatgggcttatgaaggaagctaagcacggctgctcactggcccccactttgtttcttgggtaattcacaggggaattcccagtactgtcatggagcagagcaggcagtgggtgctgatgtgtgtgcatgagctgtatgtacacatgcatatatctgttacagaagatactcctggcagtgaggtgctaagtcatcactgaggctgtgtgtgtgtgtgtgtgtgcgcgtgcccgtgtccatccatgtctctgttgtgtgtctgtgtgcgggtatgggtgggattcctggtggacaggggtgtcagatctgtctgaggagccccagtcatgctcagcacgctacagatgtgttgtttgtcacactgagattgctgaatgtcgtggctgttggctgccgagcctcagctgctggcatttccttctgctgtttgctgcttttgtgcctcccccactttccatcacctctggagtcccgtctggacgtcccttcctgctacaggaataatgaggcgtgggctgcctcccgctagggcctcctgctccctgtaggtagtttctggctgaggcttgctaattggggatgcttcttagagcatcttccacatcaactcccctggctgctggctaccgattaaattcattagtgtgaaagaggtgggagtgaggttttctggcctgaagcagtctgcactgaaaggtacccaagtggcctgaaacagtgtagggaaagacctgggaaacactggaccaaaaaagcctgatctcatggagacctgcatggccctgttagagatggcgtagaagtgaaagtcttaaagggagcattagagatccttttaatacacgactgagtgccagcttatttgtgatgccccttcccagaccaggttaggattcctgggaaggccgcggattccggccctggaagaggcaggatcctggagcagttttgtgaggcttttgtgctcccatacgccccctggtggtgagtgtaaagaagactttgcctctcacaactacatgtatgtgtggcatttttgttagagatgagaaaaggattgagaaggataaactggaatcctggtaagaagcctttatgccagcccgacacctgctgtaattggggtgcatgagctatggagtcagatagttgttgggagggggaggacaagaagtctattgtttggactgtgtttgtctcacaatcaccacaaaataaaagtgtagaaaatgcttgtggtgtactaactcttttctgtacttaagttactcagattaacatgcacttctaattctaaacattttttttggagtcatcactgtcgctgtttaagtagaacaatgccaacgatgtatgagaaacagggaataaatcaggatttgtgtgtgtatgtgtgtggcattacttacatttactttattaaaaagcctaaggaactttaaagaatttgtattcagtttatttttattttttcaagacagagtctcactttgttgcccaggctggagtgcagtggcgtgatctcggctcactgcagcctccgcctcccgggttcaagtgattctcctgcctcggtctcatgagtagctgggattacaggcgtgcgccaccatgcctggctaatttttgtatttttagtagagacggtttcaccatgttggtcaggttggtcttgaactcctgacctcaagtgatctacctgtcttggcctcccagagtgttgggattacgccactgtacccagccttagactcagtttaaaatgggcttattgtaatgaaaaaaaatacgctacccaaaatttgccatgatgcctgtgatggtgaaggcattaaacaattgaaatctttgccttgcccagagagttgcagttatttgtaattataaacagtaagtgtatcagggcaggggtgacaataaaaaaccaatcattactacc

SEQ ID NO: 2747 - DNA, 957 bp, Homo sapiens
attctcatccctgtgctcagagctctcaagcacccacgatggccttctcaggccgagcgcgcccctgcattatcccagagaacgaagaaatcccccgagcagcccttaacactgtccacgaggccaatgggaccgaggacgagagggctgtttccaaactgcagcgcaggcacagtgacgtgaaagtctacaaggagttctgtgacttttatgcgaaattcaacatggccaacgccctggccagcgccacttgcgagcgctgcaagggcggctttgcgcccgctgagacgatcgtgaacagtaatggggagctgtaccatgagcagtgtttcgtgtgcgctcagtgcttccagcagttcccagaaggactcttctatgaggaacgaacgtgatggttaagctaccttcattaagcagcatgaccgcttcctgagctcctgctgccgcatttaggccctgtcagctgtgaggccactggtgctgagtcagagggaaaagctcagaacagccttgagcagcgaagaataaagcatgactcatctcgtcctgcccacccctcacactggactataaataccctccctgggtctgtgtgctgttattccaaaagatgcgatgaatacccagaactaggctattcatgggctgttgcccagttcaagctctattgggtcctgaggaagattactattttggctacattgtttatcattaaaaccagcccagggatgtgtaaacctgcatctggagaataagacatttctttttggttaaatgatattagagaaaaaaaaaactatccaaggctgctaacaaataatcttcactttcaattatatccagcaataagttgttctccagaaaagaaagcttggaaacttacccagtttgccttccatttgggacatgactgatgtgcttcagtctttgtataataaatgcatcttcgccactcta

SEQ ID NO: 2748 - DNA, 1520 bp, Homo sapiens
agtcataaaggtctctttgccaagttactgccctctcaagctgcttccagtgaatgctacacacctgcaccatggtttgtccgacatccttagccaagatcaggattggctatgttggtacttacatatcctcatgagaattgtggttctggtactagtttggtaaagaaattattaaacctagctgatgcttgaaggtagttggattaacaggaaagaaaagagacttcttttctagccaagatgaaagatacacaagacattcaggaagcttcgaaggcaatgcagaataaagtccatgagcaggaagataagaatgagaaacaaaaacaaagagaagacaaacttggagtatattctttagtacatttttccccaaagatgttgggttcagttgccacaacactgccattgtcatcttcaaattccagtggaatgcctcttggttactatctgtctagtcctcagattagtagagtaactatatcaacaactggacaattgacttctaaagctactgtaggtagctgttccagagtggaaaacagcttggatgccagccccttctcagttccgaagaaacaggatgaatcacccatgattggggatggagaagattatttcctttctttgtttggtgattcaaagaaacttacagcacactcaaactacactcagaaaactttaaaatacttttctatgattcttgaagaagttggccaatttacctccagttctcttggagatgttgaaatagctgaagtgaatgtcaagggtttgttcgtgaagctcattaactcttcccttgacaaagaaatggcaattggagatcatattctccagcaaaatgtgaatggacaaaccatttctttgtaccgattccttccaaacatcgtaatgcaggcaaattccacagtaacagccattgcgtggtacacccctatccactggaagcaagcgtgggaaaaattagatgctgacgttgaatttaacagatgttcagtagtatctccaacattccgaaagcgtgtgtttcagtggacagcatctacagctacaataactaaagaaaaacaagatcaacctaagaaagatatctcaaattatcaggtggaacaagctcaagttcttcttaagagagagaaggaaatcccaccaaccgttttccctaatcgcagcccttggtgccagaatccctatgtctctgcacatccttactgtcctctgattgaaccacacaatacatccaccgctggaggcagattggatagacagcccaggactcggtcaaccagacctaatcgagcctcagggtctaagaaaaagaagacatctgagtcacaaaagcaataagcagtcaactcaacctttaaagctttacctttatggtgtcatggtccagttgtatggaagagtaaaaagacctgcaatctaggctccctgccatgctggccaaagacattccacaacttaaagaaaatcaaatgcctgagcaaacgtagcgggttccgctttcatag

SEQ ID NO: 2749 - DNA, 1158 bp, Homo sapiens
acgtcagagggtcgcgccgctgcaggaacccgctctgcctgagctaccgcgagtcgtagaaaattacgtaatgatagggggccggtcagagtgagggcacctgaggtacacgaaatccctccggcttgcccacttcctcggactttccaccaatcaggagcttcctccccagcaccaaccaattgtgggagagaagttttctctgtgctacaagcccggaatttcattcatacccagctacgctccgaatgagggagcagaggtacagcggccgaatgagcgggaacagttattccacgacaggtgtacatcagacgcattgcttaggcctcttattttacgttctccaagcaactccataagacaactgtctcggaaaggctacagtgatgacagaccgacttaagttcggattcggcttccaccgcttcttagtggtatgcaaagaagccttttcaccctgatgtccttagagataatatggatcagtccagagttctcctctgggtgaaagcagaaccctttatagtgggtgccttgcaggtcccccctccatccaagtttagtcttcactatctcaggaagatatccacctatgtgcaaatccgggccacagaaggagcttacccgcgcctctactggtctacatggaggcacatcgcttgtgggaagctgcagttggccaaggacctggcgtggctttacttcgaaatatttgatagtctttcaatgaagacacctgaggagcgcctggaatggtctgaggttctgtccaactgcatgtctgaggaggaagttgaaaagcagagaaatcagctttcagtggacacgctacagtttctgctcttcttatacattcaacagttgaacaaggtctccctaaggacatctttgattggcgaagagtggcccagtcccagaaacaaatctcagtctcctgacctgactgaaaaatctaattgtcataataagaactggaatgattacagtcaccaagcttttgtctatgatcatctgtctgatctcctcgagctgcttttagatccaaaacaactcactgcatcatttcattcaacccatagtagtctagtgtctcgagaagctgttgtggcgctcagcttccttattgaaggtacaataagtagagccaggaagatc

SEQ ID NO: 2750 - DNA, 1287 bp, Homo sapiens
gaactcaaggcctgcttgatacgtccgccattttgggcgcttcgctgatggtgtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgacctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtag

SEQ ID NO: 2751 - DNA, 2472 bp, Homo sapiens
actctggctgccttctcctgagagtcggagccacagccagagccctgcccaggccgagccggagctgcagcccgagcgcggtggtgccctcagccccgtcctcttgtcctcctcagcctcgatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgggctgtgcggagacacctgttcccccagcactcagcccctggccgaggtgtcgtctgggagtggctgagcgacgatggctcctggactgcctatgaagccagcgtctgtgactatctggagcagcaggtggccaggggcaaccagctcgtggacttggcccccctggggtacaactacactgtcaactacaccacccacacgcagaccaacaagacttccagcttctgccgcagcgtgcggcgccaagcagggccgccttacccggtgaccaccatcatcgctccgccgggccacacaggcgtcgcctgctcttgccaccagtgcctcagtggcagcagaactggccccgtgtcaggccgctaccgccactccatgaccaacctccctgcataccccgtcccccagcaccccccacacaggaccgcttctgtgtttgggacccaccaggcctttgcaccgtacaacaaaccctcactctccggggcccggtctgcgcccaggctgaacaccaccaacgcctggggcgcagctcctccttccctggggagccagcccctctaccgctccagcctctcccacctgggaccgcagcacctgcccccaggatcctccacctccggtgcagtcagtgcctccctccccagcggtccctcaagcagcccagggagcgtccctgccactgtgcccatgcagatgccaaagcccagcagagtccagcaggcgctcgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaaggagcgaccccgaagccagagccagagccagagcaggtcataaaaaactacacggaagagctgaaagtgcccccagatgaggactgcatcatctgcatggagaagctgtccacagcgtctggatacagcgatgtgactgacagcaaggcaatcgggtccctagctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggtatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagccaaagcc

SEQ ID NO: 2752 - DNA, 4455 bp, Homo sapiens
agagcgaagctgaggagtccagcgctcgccgacaggggcctgggctgtcccgagccggaatccagatcttacataagatggaagtctctcacactagatactgaacattaaatagaaaatctatttagtaaaatctaagttgccatggaagaaataccagtaaaagttgctgtaagaattagacctctgctttgcaaagaagctcttcataatcatcaagtttgtgtgagagttattccaaacagccagcaagttatcattgggagagatagagtcttcacttttgattttgtttttggcaaaaattccactcaagatgaagtttataacacatgtataaagcccctagtgttgtcactcattgagggctataatgcaactgtttttgcctatggacaaactggatctgggaagacatacaccattggagggggccatattgcttcagttgtggagggccaaaagggtatcattcctcgagctattcaagaaatatttcaaagcatctctgaacatcctagcattgactttaatgtaaaagtatcttatatagaagtgtacaaggaagacctaagagatcttctagaattggagacatccatgaaggatcttcacatccgagaagatgaaaaaggaaacacagtgattgttggggccaaggaatgccatgtggagagtgcaggtgaagtgatgagtcttttggagatggggaatgcagccagacatacaggtaccactcaaatgaatgagcactccagcagatcacatgcaatttttacaatcagcatttgtcaagttcataaaaatatggaggcagctgaagatggatcatggtattcccctcggcatattgtctcaaagttccactttgtggatttggcaggatcagaaagagtaaccaaaacggggaatactggtgaacggttcaaagaatccattcaaatcaatagtggattgctggctttaggaaatgtaataagcgctcttggggacccacgcaggaagagttcacatattccatatagggatgctaaaattacccggcttctgaaagattctctgggaggcagtgctaagactgtcatgatcacatgtgtcagcccctcctcctcgaattttgatgagtccttaaattctctcaaatatgccaacagagcacggaacattagaaacaaacccactgtaaacttcagccccgagtcagaccgtatagatgaaatggaatttgagattaaattgcttcgagaagctttgcaaagccagcaggctggtgtcagccaaactacccagatcaatcgagaagggagtcctgatacaaataggattcattctcttgaggagcaagtagctcagcttcaaggagaatgtctgggttaccagtgttgtgtagaagaagcctttaccttcctggttgacctaaaagatactgtcagactaaacgaaaagcagcaacacaaactgcaggagtggtttaacatgatccaagaggtcaggaaggctgtcctcacctcatttcgaggaatcggaggcactgcaagtctggaagaaggaccacagcatgttacagttctccagctgaagagagagcttaagaaatgccagtgtgtgcttgctgctgatgaagtagtatttaatcagaaggaactggaggtgaaggaactgaagaatcaagtgcagatgatggtacaggaaaacaaagggcatgctgtatctttgaaagaagcgcaaaaagtgaatagactgcagaatgaaaaaataatagaacaacaacttcttgtggatcaactgagtgaagaactaacaaaacttaacctgtcagtgacttcttcagctaaagaaaattgtggagatgggccagatgccaggatccctgaaaggagaccatatactgtaccatttgatactcatttggggcattatatttatatcccatcaagacaagattccaggaaggtccacacaagtccgcctatgtactctctggatcgaatatttgctggatttcgaacacgaagtcagatgctgttgggtcacatagaagaacaagataaggtcctccactgccaattttctgataacagtgatgatgaagaatcagaaggccaagagaaatctggaactagatgtagaagtcgttcatggattcagaagccagactctgtttgttcccttgttgaattgagtgatactcaggatgaaacacaaaagtcagatttggagaatgaagatttaaagattgattgtctccaggagagtcaagaattgaatttgcaaaaattaaagaattcagaacgcatacttactgaagctaaacaaaaaatgagagaacttacaattaacatcaagatgaaggaagatctgattaaagaattaataaaaacaggtaatgatgccaagtctgtaagcaagcagtattctttgaaagtaacaaagctagagcatgatgcagaacaggcaaaagtcgaactgattgaaacacaaaagcagctacaggagctggaaaacaaagatctttctgatgttgcaatgaaggtaaaattacagaaagagtttcgtaaaaagatggatgctgcaaagctgagagttcaggaaatacaattaaaaacaggacaggaagaaggtctaaaaccgaaagctgaggaccttgatgcatgtaacttgaaaaggagaaaaggttcgtttggaagtatagaccatctccagaaattggatgagcaaaagaaatggttagatgaagaagtagagaaagttctgaaccaacgccaagaattagaggagctggaagcagacttaaagaaacgggaggccatagtttctaagaaggaggctctgttacaggagaagagtcacctggaaaataagaaattgagatctagtcaggccttaaacacagatagtttgaaaatatcaactcgcctgaacttactggaacaagagttgtctgaaaagaatgtgcagctccagaccagtacagctgaggagaaaacaaagatttcagaacaagttgaagtcctccagaaagaaaaggatcagctccagaaacgcagacacaatgtggatgaaaaacttaaaaatggtagagtgttatcacctgaagaagaacatgttcttttccaacttgaagaagggattgaagctttggaagctgcaattgaatacaggaatgaaagtatccagaatcgccagaagtcacttagagcatcattccataacctctctcgtggtgaagcaaatgtcttggaaaagctagcttgcctgagtcctgttgagattagaactattcttttcagatatttcaataaggtggtgaatttgcgagaagctgaacggaaacaacagttatataatgaagaaatgaaaatgaaagttctggaacgggataatatggttcgtgaattagaatctgcactggaccatctaaaattgcagtgtgaccggagactgaccctccagcaaaaggaacacgaacaaaagatgcagttgctattacatcatttcaaagaacaagatggagaaggcattatggaaactttcaaaacatatgaagataaaatccagcagttggaaaaagatctttatttctataagaaaaccagccgggatcataagaagaaacttaaggaactggtaggggaagcaattcggcggcaactagcaccatcagagtatcaagaggctggagatggagtcctgaagccagaaggaggaggcatgctttcagaagaattaaaatgggcatccagacctgaaagtatgaaattaagtggaagagaaagagaaatggacagttcagcaagcagcttaagaacacagccaaatcctcaaaagctctgggaagatatcccagaattacctccaattcatagttctttagcaccccccagtgggcatatgttaggtaatgagaataaaacagaaacagatgataatcagtttacaaaatctcacagtcgactgtcatcccaaattcaggttgtgggaaatgtgggacgacttcatggtgtcacacctgtaaaactgtgtcgaaaagaattacgtcaaatttccgccttggaactatcattgcgacgttccagtcttggagttggcattggatcaatggctgctgattccatcgaagtatctaggaaaccaagggacttaaaaacttagacattgaataatagaacttttagtagatatgtaaaaagattcctttttctaacctgttaaaaactaaagctcaagttcactacctctttcctcagaataaaggaagaaggggaggaaggaatccctaattcttttatatgctatagatgtgtacatcttctatatatatttggggagttttagtttatattcccatagtaatcaaacatgttttccaatacttgataacatttaaatatttataaatacgcttaaatgtttttccaggcatatttgaagattaaaactagtaatagactaaaa

SEQ ID NO: 2753 - DNA, 2967 bp, Homo sapiens
cgtgactgaactcgaggaggacctgggcacggcccgccgggacctcatcaagtcggaggagctgagcagcaagcatcagcgggacctccgggaggctctggcccagaaggaggacatggaagagcggattactacactggagaagcgctacctggctgctcagcgtgaggcaacatccatccatgacctcaatgacaagctggagaatgagctggccaacaaggagtccctgcaccgccagtgtgaggagaaggcccgacacctgcaggagctgctggaggtggcagagcagaagctgcagcagacgatgcgcaaggcagagacgctgccagaggtggaggctgagctggcccagagaattgcagccctcaccaaggctgaagaacggcatggcaacattgaggagcacctgcggcagctggagggacagctggaggagaagaaccaggagctggcacgggtgcgccagcgggaaaagatgaatgaggaccacaacaagcggctgtcggacacagtggaccggctgctcagcgagtccaacgagcgtctgcagctccacctgaaggagcgcatggctgccctggaggagaagaacacgttgatccaggagttggagagctcccagcggcagattgaggagcagcaccaccacaagggccgcctgtctgaagagattgagaagctgcgccaagaggtggaccagctgaagggccgaggggggccgtttgtggatggcgtccactccaggtcgcacatgggcagtgcagcagacgtgcggttctccctgggcacaaccacacacgcacccccaggcgtgcatcgccgctactcggcattgagggaagagtctgccaaggactgggagacttctccactgcctgggatgctggccccggcagctggccctgcctttgacagtgaccctgagatctccgacgtggatgaggatgagccagggggtctggtgggctctgcggatgttgtctcccccagcggccactcagatgcccagaccctggccatgatgctgcaggagcagctggatgccatcaatgaggaaatcaggatgattcaggaagagaaggagtccacggagctccgcgcggaggagattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctgcccagtgacttaagaaagcataggaggaagctgctgtcgccagtgtctcgggaagagaaccgagaggataaagccaccataaaatgtgagacttctcctccttcctcacccaggacgctgcggctagagaagcttggccacccagccctgagccaggaagaaggcaagagtgccttggaggatcagggcagcaaccccagcagcagcaacagcagccaggactccctgcacaagggcgccaagcgcaagggcatcaagtcgtccattggccgcctgtttgggaagaaggagaagggcaggctgatccagctgagtcgggatggagccacaggccatgttctgctaacagactccgaattcagtatgcaggagcctatggtgcctgccaagctggggacccaggcagagaaggaccggcggctaaagaagaaacaccagctgcttgaagatgcccgcaggaaaggaatgccctttgcccagtgggatggtcctactgtggtctcctggttggagctctgggtggggatgcctgcctggtatgtggcagcctgccgggccaacgtcaagagtggtgccatcatgtccgctctgtcggacacagagatccagcgggagatcggcatcagcaatgccctgcaccggctcaagctccgcctggccattcaggagatggtgtcattgaccagcccctctgccccacccacctccaggacttcttctgggaatgtctgggtcacccatgaagagatggaaactctggaaacatctactaaaacagacagtgaggagggcagctgggctcagaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggcacgccaagtgatggaaagagagttcaataacctgttggccttgggcacagaccggaagctggatgacggggatgacaaggtgtttcgccgcgcgccctcctggaggaagcgcttccggccgcgggagcaccacggtcgcggcggcatgctcagcgcttccgcggagaccctcccggcgggcttccgtgtgtccaccctggggaccctgcagcccccaccggccccgccaaagaagatcatgcctgaagctcactcccactatctctacggacacatgctctccgccttccgggactagccatggcccccagggctggcttcctccttctgggtttcacaggctcctctggccctgacccctcttgctcgttccccttccttccgcagctcctagtctcgtccgtg

SEQ ID NO: 2754 - DNA, 2815 bp, Homo sapiens
gacgtcggcggtgacaggccctgggactctgggaatacccagcttcctccccgcaacccggtgaaagccaacgcaatgttcggtgcgggggacgaggacgacaccgatttcctctcgccgagcggcggtgccagattggcctcactttttggactggatcaggcagctgctggccatggaaatgaatttttccagtacacagccccaaaacagcctaagaaaggccagggaacggcagcaacaggaaatcaggcaacaccaaaaacagcaccagccaccatgagcactcccacaatactggtcgcaacagcagtccatgcatatcgatacacaaatggtcaatatgtaaagcagggcaaatttggtgctgcagttctggggaaccacacagccagagagtataggattcttctttatatcagtcaacaacagccagttacggttgctaggattcatgtgaactttgagctaatggttcggcccaataactatagcaccttttatgatgaccagagacagaactggtccatcatgtttgagtcggaaaaggctgctgtggagttcaataagcaggtgtgcattgctaagtgcaacagtacctcttccctggatgcagtgctctcccaggacctcattgtggcagacggccctgctgtagaagttggagattctttggaagtggcctataccggctggctctttcagaatcatgtgctgggccaggttttcgactccactgctaacaaagataagttgcttcgcttgaagttaggatcaggaaaagtcatcaagggctgggaggatggaatgctgggcatgaaaaaaggaggaaagcgattgcttattgtccctccagcctgtgctgttggctcagaaggggtaataggctggactcaagcaacggactcgatcctggtgttcgaggtggaggttaggcgggtgaagtttgccagagattctggctctgatggtcacagtgttagttcccgcgattctgcagctccgtctcccatccctggtgctgacaacctctctgctgatcctgttgtgtcaccacccacatcaatacctttcaaatcaggggagccagctcttcgtaccaaatctaactccctcagtgaacaacttgcaataaatacaagtcccgatgcagtcaaagccaagttgatctctcggatggctaaaatgggccagcccatgctgcccatccttccaccacagctggattccaatgattcagaaatcgaagatgtgaacactctgcaaggaggtgggcagcctgtggtgactccgtccgtccagccctctcttcatccggcccatccagcgttaccacagatgacctcacaggcacctcagccatctgttactgggctccaggcaccttctgctgccttaatgcaagtgtcatctctcgattcccactcagctgtatctggaaatgcccaatcctttcaggtaacattttataaccgtattaattatatcctataatttgctgtggttctagtcagtctcttttcttcttcctgtacatttcatacagtagcagttccccaaagtcagagtttgtaatttttttcccttccttggttaccactttctcatctctaaaccaggcaaaggataacctacgttccagtgtcataaagattaaatgcaagaacaagtagagcccctagtacaacgtagtaaagatgcaatcaatgtttgtttccttttcttttcacacatatccagttgaagcgtgtatattcgcgttcttctgtattcttttctactaaaagttggcaggctaacattctgcagtatattcagcagaatggtatggtttaaaagtggaaccatgtggaaaatgtagcttgactctgctatctagtaaacttttcttaaagaaggcctttttcctgttatcacagaaaacaatggcagcagcctgtttgccaggggtagcagaccctttcttctgcctcaacacacttggtggataaggcatactgtcactgggaacagctgctcactccttgtgatgcttaatggaggtgtgggaatgatggtggataggctatgcctcattaacatggggagtctcgaaactggaaaaagtcccactgttgccctctttctccccatccctcctctcctccatggagaattactatgctgtagactaagaattttttttaagtggatgcgtagttatatctatccctggaaatgagctagacttccttatttcaaggaagaattaccatcctcattaaaataaaagctgctgtttattaagcgcttactatctgtcaggcctgtaacttactagcttttcagaactttacctatctcacttcatttagtccacagaacagccctatgaagtgatattattatcttcctcttacagttgaggtgaccgagactcaaaggaacatgagagctcttggtctcgtggattagcttcagaatctagcaggggagaggcatccttggaaattggcagatttggtttggaatctcagtgagcacttcttctttaaactcaatggaagctaagcagagtttattaatctaaaaacttcttagacaataggcctgataatggggaatgaatccctgcttaattatctcaccagatgactgggtagtgacctaagatacactttcttcagtttctgggtaggattttagtgactggtttcccctgggatacatagataactctcctgctgcagtccttaccaactgccaaacccagatctcacccatctctagcttcagtaagtttgagtctcctcccagctcatccactttattccac

SEQ ID NO: 2755 - DNA, 566 bp, Homo sapiens
acagtctcagggatgagcagccgcccaagctgcagggcctcgggtcttcggcgcctctgaccctcgcaggttgctgcctttcggtgcagaaccgtctctgaaagaagatgaatttggctgagatttgtgataatgcaaagaaaggaagagaatatgcccttcttggaaattacgactcatcaatggtatattaccagggggtgatgcagcagattcagagacattgccagtcagtcagagatccagctatcaaaggcaaatggcaacaggttcggcaggaattattggaggaatatgaacaagttaaaagtattgtcagcactttagaaagttttaaaattgacaagcctccagatttccctgtgtcctgtcaagatgaaccatttagagatcctgctgtttggccaccccctgttcctgcagaacacagagctccacctcagatcaggcgtcccaatcgagaagtaagacctctgaggaaagaaatggcaggagtaggagcccggggacctgtaggccgagcacatcctatatcaaagagtgaaaagccttctacaagtagggac

SEQ ID NO: 2756 - DNA, 1142 bp, Homo sapiens
atgttccaggtcccggatagcgagggcggccgcgccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtgagggtggggaggtggggcagggcatggtccttggatcaacagcccgccagctgattggatgtctaggaatgactgaaagaaaccaaaacagcctgtccactgctgctgtgggatggaggaggcgtaagcagaaacactaacagtatattgacctcttagcagaaccgcttccattctggagatcacggctgctaaatccagcatccccacttcattttacccccagcatattgttctgtagtcttttcttgaaacatcttgattgcttttcctcggcagctttcaaaaaaccaaataataatagttatccgtcttctacttcatggaagattgttttggtgccctgaccctctgaagtgcccagttcctgccatctgaaacctcggcctgatctgatctcatgttggaatctgcctgtctttcacacagggctggtcttggtcctttacatgccagttttgcttgtgaattcttgcttttttcctctcatcagccttaagtttaggcgtttgttgttctccagtgatgtagacagttcccttcacaagtcacagttcttcccataaatg

SEQ ID NO: 2757 - DNA, 778 bp, Homo sapiens
ggccgctccgcccggggccctagagccagccggggagctgcagctcagcggcgcccggcagggtcgggctgggctgggcccggccgacccggggagggggcggggtcaccccagcctcacctctgggcgcccaggcgctccgcggggtgagggttcggcggccactcctgggactctgggctgcggtagatgccgttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcactcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccacca

SEQ ID NO: 2758 - DNA, 6872 bp, Homo sapiens
cggagggagtaggagagcccggggcttcggcaggcagagcaggcctctcccctccgtcctcgtcgtcctcgtcctcctcctcctcctcctcctccgtggtggtagtggtgggacttcccccggctgctgcccctcccgccgccgctgctgtcccccaccgaagtagcggccacagcctggtcagcggcagcatcatgcaggccaatggggcaggaggaggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaaccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtggtaagaggcgcacttgaaatctctcaaacgttgttgggaataattgtgaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagacctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtaggaggcagttcccatgttatacgcagcagatacttacggagcattgtaatgaagtgtggttctgtaaattctctaatgatggcactaaactagcaacaggatcaaaagatacaacagttatcatatggcaagttgatccggatacacacctgctaaaactgcttaaaacattagaaggacatgcttatggcgtttcttatattgcatggagtccagatgacaactatcttgttgcttgtggcccagatgactgctctgagctttggctttggaatgtacaaacaggagaactaaggacaaaaatgagccagtctcatgaagacagtttgacaagtgtggcttggaatccagatgggaagcgctttgtgactggaggtcagcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcatgttttggaggccataatgaagacttcatcgctagtggcagtgaagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggaccagcaccttttatagaccaccagaatattgaagaggaatgcagtagcatggatagttgatggtgaatttggagcagacgacttctgtttaacttaaaattagtcgtattttaatggcttgggatttggtgcaaacaaacatgattgatagctggacagacatgctcgtcatgaaaaaagaaccatttctgaagcccgattggggccaaacatttacaccttgcttcatagtaaccagttgagatgaagcacgtcgttagaacgttgttggacaccatgttgaattattcccccatcggttgtgaagaactgtgctacattcaggcttacccattgaactcagtatatatatttttttccttcctgtcttttgtctggcaggataccattcttgttgctcttctgtgtaatgaagtttaaatgcttgtttggaaaactttatttaacagtttagaaggcttgatagaaagagtgcattagtctgaagagtatacattggataggaaagaatttccttcttttgtttctccaaatctttccgccttatttagcttgagatctttgcagcttggttcatggattctagccttgcccgttgcgcagtatatactgatccagatgataaaccagtgaactatgtcaaaagcactctcaatattacatttgacaaaaagttttgtacttttcacatagcttgttgccccgtaaaagggttaacagcacaattttttaaaaataaattaagaagtatttataggattaaagtgacttcatttgtatacatttggaatctaaaccagcttaaaaacagtttcctcaatgacttagatacacagtataactgatgctcttctggaataccacatgagacatggtcagaaacagtgcttggaaggacattacacaagaaattcagagtaatgctttgaagatttccccccttttgttttattcctgaaggaacatcagtacccgatcttgaagaaattcaagattcaaaaagaattttaaatacaccaacatgagacatcagtagtcagttggttttcagtaaagcttgttccaagttgttctcaacttaggaagtaattttggtgtgatctagcaaaagagtaggaatcagcgatacaaccactttggaagtttatagtataattgaaattattagaagaattcagcaggttacagacatacttaaactgggattaaaacctcatagtcatttttcttaattgcccttaatattttgacatatagggatacataaatttaaagaatattttttctcagttttttcagatattgccatactgaacctcattctaaactggtgctgtggatagtctttccctctcccctcctgttttagtttaaggaaaggtttccttcatggaaaagcacttttaattttgagaatttcacatttaaaataagccaaaagcctgatgttcacattgtgcttttaaactccgtaacagctgaatacaacataacatagtctcccttgaaattccctccctttttcagtagaggataaatagggtgactccagctgttggaatgagaatggggatacccccaaaataagattctggtgaagaaaaagtcttgtactaagttcccctttaggtgtagccaagtctataatataattatgatcatgaatagactccagaatccacaaagagaagagggcttggatgtcaaaaattcttccattgtggggtaggtggtcggggatgggagaaagggaaaagtcagggaaggggagaagaaagaaaaacacatttggccttaaaatagcatgcattctcccagaagcccatagtaaagaaaatgacagatcgtggtcagcagactcttatcaaattggtatgtaaaagatttcttcaagctccattttgcagagaccaccacttagagaatcaaaaaattcctgttttgatacttctaagttaaaatatatgttacagtttatctggtacttcatttttcttaactaaaattactttttactttaagcttgaataaaaatcttcattggtaactgtatgtaattaagtggcaacttctctttacctcagtatagttaaaaaccattcatattttaagtgattcatgtataccctgaagccgttaatacaccccagtctctatggtaacatcactaaatgtgggcatagaaactccacagctgtttacaaatttggttacagtgtgctacggtgcatttgtaacactcagatttgtgcccattcaggggcaatttggcactcagattctactctacttcacctaaccacccctagatctgagttttcagagtgcttctgaagtacagtttaaaaacactttttaaaaagtggagtaaaagtgaggcacattttacaagaacataactcctattaaaacggagtaacaactatgcaaaggtttctatagcagctaggtgagtttgttttccgggtctgtcttaactggcagcttcctgtacatactggtacttatttgctgtaaacgtctgtttcatacatttgccatgcagtgactgtgctcgaaaggtgaaatcaatggtaaagaagcctaggattttatggtatgagaaactgatcgcaggattttctgatccatagctattaattgaaaacttctgatagtgctgtaggctctatagtaggcttaagagtgagtcttatactatgaagccagccacaagatactaacaaatgtataaattgaaaagtaccaatactttttgcacatagatcaaaatagagtggagaatttgggctccaaaaatcaggttagtaggctcatttccatgtgcttaaaaatgtttttgttgttatgcattgattaagggctagagcaaatataaaattaaatgtctttttcctccaaataattggttattaatggtaaaatgttggacttggggattactgagattagtatgtgggtagtaaagaattggagtgggagttagtggggagggatgacaaagcttcagctttggtttttgtatttttttagtcttcataacagctacatttctgttgctcttattggccagataaatgtgttatattaaaccaggtaagtattttaaacagagaacattttatttgcatatatccctacaaattggcccattttattgggtggggggataaaaaagggattccctaactttaaataatcagaatatcctgcaattgaaaggagaaaaaaatccaattttgtcagtattttcttagtctgaaaaaaacagcagtagtaatctggtgaatgttattattaggagtgttctgcctctacagtggcatattccatgacattaatagaaaacccttctttcccacccctccccatcttgacattttcttttttaggatgttggttcctgcaaacaagaactgaccctatcacctctgcctcacagtgggtaaatatatcatacatctcttgaaagggaaaatatccatgtcagtttctttcacagtagaagaatggctgcttttgaatggggaggaaagaagacatttttcttaatatcctttttgtcccatctctaaaatgtataaatattttgatttggttttactttaatttctcattcataatttcgcaactgtccttttgggttgccctccaacacattacttccatttcagaaaccatatctgatttaatataaactgctaacttaagaagaggtgaatttgcatttacacttagacactttctaaaaacagggtgaacttaattgaaatttttcagtgttgttaagctattgttatagtagctgccctatagttacaaaaataaaaactataaaaacccatcccctatctacttaatccagatagcctggatttaacaaaaccaatagtataaaaatgtgtgtgtgtgttctgtgtgtgtgtgagagagagagtacttgattcattaaaaagtcctggaaacagctgttctaggatcttgtcatttttactgaaagtctcgtgcacatgtgaagtgccctctgagtttaaggtttggttaatactggtatatttttataagattgaaattgtgtccccatctttaacttaaacattttcattatcagggtcaatgtgctagaactgaattgtaacatttttaggcacagatggaaaaaaatgttattggctccttgaaaatgtgtgtgtgtggcgaggggaatagatccacaaaagcatgtatgtacttacaaaccaagctgtagagatcaagaaaagaacttaagtgttgatctcaagatttctaaattgtcaagatttacatggcattgtggtggaactagttaacacttagagcttttggtatgtaataactatttgctatggactgattaaatgtttcaaaagattgtgttcttcaattttggtgggttttgatttttgtttttttaactgcctctcagattatatttacttagtttaaatttctttgctttattcattaaagtataaaaacttcaggtctctgatatttattttcacttgtttactaattatttacaaaacaccctttgttgacttttattttataaatgtgtaatgtattaaacgtctttaaatttttgttcaactgaaactacattaactttgatttgctttactgggatttttttttaaagacactttttccatgtcagtgcgcagcacttaaccagtcgtttgtattccctttctttcaatccaataaacagaatgaatacctaaataa

SEQ ID NO: 2759 - DNA, 1706 bp, Homo sapiens
atggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcagtctccctttagttcctggcttcccttaccctactgcagccaccacggcagccgctttcagaggagcccatttgaggggcagagggcggacagtatatggtgcagtccgagcggtacctccaacagccatccccgcctatccaggggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctc

SEQ ID NO: 2760 - DNA, 460 bp, Homo sapiens
acgctgcgggtcctgggcccaggccttgggatgggcgggaaggcctggccgcgccgggctgtgggcactgcaggaggcccctgtgcagatctcggcccctttccaaacactcctgatgcctcatttgcctctcgcttcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggctactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccg

SEQ ID NO: 2761 - DNA, 4493 bp, Homo sapiens
cccagatagtcacatttaaaggttgctagtttgaaatttgcaaatgcttccctgctgtcagagttaggtttcctacagctgtaagatagctgctactcaacctacagcagatgcccgtgacattgtgtgttcctgggtgtatctcccatctagcaactccaaactgtgtatgctgtagtttgtgttcctggaactactatcttcaggagaagcttcagttataaatagtaattggagtgaagagatgagttctgtttaggggagatccattaactttcaacaagggaggacagggactttttcaataggaattgcaataacatggtttgtttttgaaaatgcaatagactgtggattaaatagctattgcacacaaagaagaaaataaagttataatctccagcatgagatctggatttacatatgctctgttagctgcaagaatttgggcaagctatttaatttccataaatttaggtatccttaagatacccactgcttagagttattgtgagaattaattgaggtaagaaaactgaggctcaggttgtcatttgctcaaatcacacagcaaaaccgtgatagaatgcagattcaaactgggatattaacattccaaagcctttacagttattgactactattcagcactgccttcaatatatgctgatgactgcacacaggagttagaaatgcccactgtcacttgcctgccttgagcggtttcttgtttgtataaataatccaaaatacttggttgtgttgtaagaagcaccgtgttttgtgagacatttcaaaggtaccacaaataggaaagatttcattctagaatgaatagagcacatatttagtatctacgtgctgtttggttaattttagttatttggtcatgcttttaaaatctatttttatagtatatattttcttttatagcatatcagaattatctttagattcaactcttcatgccgtcaatcttcattgcaataacatctccaagatcgaagccattgatcatatttggaatttacaacatctagatctgtcatctaatcaaataagtagaattgaaggactaaacacactgacaaaactgtgcacattaaatttgtcctgcaatttgattacaaaagtagaaggacttgaagaactaattaatctgactagactaaatgtatcttataaccacatagatgatcttagtggattgattccccttcatggaattaagcataaacttagatatattgatctacatagtaatcgtatagatagtatccatcacttacttcagtgtatggtaggattgcacttcctgaccaatcttattttggagaaagatggagacgataatcctgtctgtcgactgccagggtacagagcagttattctccagactttgccacagcttagaatcctagattgcaagaacatatttggtgaaccagtaaatttgacagaaataaattcatcacagctgcagtgcctagaaggtcttttggataatttagtttcttctgattctcccctaaatataagtgaagatgagatcattgatagaatgccagtgataacagcacctatcgatgagttagttcccttggaacagtttgcaagtacaccaagtgatgctgtgttgacgtcttttatgtctgtgtgtcaatcttctgagccagagaaaaataatcatgaaaacgatttgcagaatgagataaaacttcagaaattagatgaccaaattctacaacttctaaatgaaacttctaattcaatagataacgttcttgagaaagaccccagaccaaaaagagacacagatataacttctgaaagtgactatggaaacagaaaagaatgcaatagaaaagttcctcgaagatcaaaaatcccttatgatgccaaaaccattcaaactattaagcaccacaataaaaactacaactcttttgtaagttgtaatcgtaaaatgaaaccaccttaccttaaagaattatatgtaagctcatctttagcaaactgtcctatgttacaagaatcagaaaagccaaagactgaaataattaaagtagaccaaagtcactcagaagacaacacttaccagtcccttgttgaacagctagaccaagagagagagaagagatggagagctgagcaagccgaaaataaactcatggattatattgatgagctgcataaacatgcaaatgaaaaagaggatattcatagtctggctctacttaccacagataggctaaaggaaattatttttagagagagaaattccaaaggacaactcgaagttatggttcacaaacttcaaaatgaaattaaaaaactgactgttgaactaatgaaagcaaaagatcaacaagaggatcaccttaaacacttaagaaccctcgaaaaaacattagaaaaaatggagagacaaaaaaggcagcagcaggcagcacagataagactgatccaagaggtggaactcaaagcttcagctgccgatagagaaatatacttacttagaacttcccttcatcgagaaagagaacaagcgcaacaacttcatcaacttcttgcattgaaagaacaggaacacaggaaggaacttgaaacaagggagttttttactgatgctgacttccaggatgccttagctaaagaaatagccaaagaagagaaaaagcatgagcaaatgataaaagaataccaagagaaaattgacgtgttaagccagcagtatatggatttagaaaatgaattccgtattgctttaactgttgaagccagaagatttcaagatgttaaagatggttttgaaaatgttgcaactgagttagcaaagagcaaacatgctcttatttgggctcaacgaaaagaaaatgagtcttcctctttaattaaagatctgacctgtatggtaaaggaacaaaaaacaaaactggcagaagtttctaaattgaaacaagaaacagcagcaaatttacagaatcaaatcaacacccttgaaattttaattgaagatgacaagcagaagagtattcaaatagaacttctcaagcacgaaaaagtccagcttatttctgagctagcagccaaggaatcactaatatttggtttaaggacagaaagaaaagtatggggacatgagctggcacaacaaggatcttctctagcccaaaatcgtggaaaattggaggctcaaattgagagtttatctagagagaatgaatgtctgcgaaagacaaatgaaagtgatagtgatgcattaagaataaagtgcaaaatcatagacgaccaaactgaaactattagaaaattaaaagattgtttacaagaaaaagatgaacacatcaaaagattacaagaaaagatcacagaaatagaaaaatgcactcaagaacaacttgatgaaaaatcttcacaactggatgaggtacttgagaagttggaaaggcacaatgaaagaaaagaaaaactaaaacaacagttgaaaggaaaggaagtagaacttgaagaaatcagaaaagcttacagtacactgaatcggaagtggcatgataaaggagaacttctatgtcatcttgaaacacaagtaaaagaagtgaaagaaaaatttgaaaacaaggaaaagaaacttaaagcggaaagagacaaaagtattgaactacaaaagaatgcaatggaaaaacttcatagtatggatgatgcctttaaaagacaagttgatgcaattgttgaagctcatcaagctgaaatagcacagctggccaatgaaaagcagaagtgtattgattctgcaaatttaaaggtccatcaaattgaaaaagaaatgcgtgaacttttggaagaaacatgcaagaacaaaaaaacaatggaagcaaaaattaagcaacttgcttttgctttaaatgaaattcagcaagatatgtgatggttctgagaatgaatttaattgaaatagaccagcagacctattgtaaaaatgattaaatattgtaatagtagtaactgctatgactttgaaatgtctctttctatacatttcattatgaatatatttttaaagacttttgatcaagtatttattaattgtataggttttttataataaattgttgacaattttgtctattagaaaaaactatcataactagacttacaatatttttcttgtttctgtactatacattgtttggtaattacacatttgcctacaaatttgtgaatgaaaagattagtattttcaccatatgaggtaaaacattttaatcattgttatcttattgtgatgatgaagaactaattatatttgttatttaattgatgtagctcaattcttttaaagtacttatgtagccaaaaagcatttgaaatctgtatgataaaagatgtggcattcttaagaaagtatatgtagccatctccacatcactcattatgaccccttcttttataatgcttatatcttttcattaaagattacatttaaggtttta

SEQ ID NO: 2762 - DNA, 6676 bp, Homo sapiens
gtgggctcggcccgggctgccacgagcgtgcgggcctcgccgggcatgtcctaggcggcggccccgcccagcgctcggccgggcgggcgggcgggcgcgagggcagggaccgagccgggccgagctggggaacaagccggggaccaagccggggaccaagccggggactaaggcgagccggagaccgagcccgaacagcagggccagacgggcccagccagcaccaagatgagtgccacgtcctggttcctggtgagcagcagcggcgcccgccaccggctccctcgggagctcatcttcgtggggcgtgaggagtgtgagctcatgctacagtcccgcagcgtggacaagcagcatgccgtcatcaactacgaccaggacagggacgagcactgggtgaaggacctgggcagcctcaatgggacgtttgtgaatgacatgcgcatcccggaccagaagtacgtcacgctgaagctcaacgatgtcatccgcttcggctacgattccaacatgtatgtgctggagcgtgtgcagcaccgagtcccggaggaggcactcaagcatgaaaagtacaccagccagctgcaggtgagcgtgaagggtttggcgcccaagaggagcgaggcactgccggaacacacaccatactgcgaggcctcgaaccccaggccggagaagggggaccggagaccaggaacagaggcagcctcttaccgcacacccctgtatgggcagccctcctggtggggtgaggacgatggtagcacgctgcctgacgcccagcgccagggagagccctacccagagcgccccaagggaccagtgcagcaggacggggagctccacggcttccgcgcccctgctgagcctcagggctgctcgttccggcgggagcccagctacttcgagatccccacgaaggagaccccgcagccgtcgcagccccccgaggtgccggcacacgagatgcccacgaaggatgcagaggcaggtgggggcggagcggcccctgtggtgcagagccacgcctccttcaccatcgagtttgatgactgcagccctggcaagatgaagatcaaggaccatatcaccaagttttccctgcgccagcggcggcccccgggcaaggaggccacacctggcgagatggtgtcggctgagaccaaggtggccgactggctggtgcagaatgacccgagcctgctgcaccgggttggccctggggatgaccgccacagcaccaagagcgacctgcctgtccacacccgcaccctgaagggccacaagcacgaggacggcacgcagagtgactcagaggaccccctggccaaggcggcctcggccgctggggtgcccttggaggccagcggggagcaggtgcggctgcagaggcagatcaagcgggacccccaggagctactacataaccagcaggcctttgtcatcgagttcttcgacgaggacacaccccgaaagaagcgctcccagtccttcacgcacagcccgtccggggaccccaaggccgacaagcgccgtggcccaacgccggccgatagggaccgccccagtgtcccagccccagtccaggcagggggccgcagctcggggccacagagggccggctcgctcaagcgggagaagacagaggaacggctgggcagcccctcgcccgcctcccgaacccctgcccgccccttcggaagcgtggggcgccgctcccgcctggcccaggacttcatggcccagtgtctgcgggagagctccccggccgcccggcccagccccgagaaggttcctccggtgctgcccgctcccctgacaccccatgggaccagccccgtgggccccccgaccccaccgcccgcccccacggacccccagctgaccaaggcacggaaacaggaggaggacgacagcctcagtgacgcagggacatacaccatcgagaccgaggcgcaggacacggaggtggaggaggcccggaagatgatcgaccaggtctttggggtgttggagtcccctgaactctccagggcatcttcggccacctttcgcccagtcatcagaggggacagagatgagtctgatgacgggggcgtggcccagcggatggcgctactgcaggagtttgcctcccggccactgggtgcggccccccaggcggagcaccagggcctcccggtgccgggctcccctgggggtcagaagtgggtgtcccgctgggccagcctggctgacagctactcagacccgggcctcacagaggatggcctgggacgtagaggcggggagccggaggggtccctgcctgtgcgcatgcggcgacggctccctcagctgcccagtgagagggctgacagccctgcgggcccagagagcagcaggaggagtgggcctgggccaccggagctggacagtgagcagcccagccgcctcttcggccaggaggagttggatcctgacagcctcagcgatgccagtgggtcggacgggggccgaggccccgagccaggggtggagccacaggacagcagacgcaggagcccccaggaggggcccacgtggagcaggggtcggcgctcaccaagggcccccggggagccaactcccgcctctttcttcattggggaccagaatggggacgctgtgttatctaggaaaccgcttgcggctccaggggatggggagggcctagggcagacagcccagcccagccccccagcacgggatggcgtctatgtcagtgccaatgggagaatggtcatccagctacggcctggacggtccccagaacccgacggccctgccccagcctttctccggcaagagagcttcactaaggagccagccagtggtcccccagcgcccggcaagcccccccacatctccagccacccgcttctacaggacctggccgctacccgggccgcacgcatggacttccactcccaggacacccacctgatcttgaaggagacggagacggccctggcggccctggaggcccgactcctctctaattctgtggatgccgagtgtgaggggggcagcaccccgaggccgccggaggacgccctgtctggggactcggacgtggacacagccagcaccgtcagcctgcgtagtggcaagagcgggcccagccccacaaccccccagcctctgcgggcacagaaggagatgtcgccatccccgccagctgcacaggacccgggaggcaccgccctggtcagtgcccgtgagcagtcctcagagaggcagcatcacccacttggcccgacggacatgggccgtggagagccggtacggcgctcagccataaggcgtggccacaggccccgagggtccctggattggcccagtgaggagcgtggccctgtcctcgcccacctacccagctcagatgtgatggcctccaaccacgaaacccctgaggccaccggggcaggacggctaggttctcgccggaaaccagcggccccaccgccatccccagctgcccgggaggagcagagccgtagctcagccagctcccagaaggggccgcaggccttgacccgctccaacagcctgtccacccctcgccccacacgggcctcccggctgaggcgggcccggctgggggacgcttcagacactgaggctgcggatggtgagcgggggtccctgggcaaccctgagcccgtgggccggccagctgctgagcaggccaagaagctgtcacgcctggacatcctggccatgccccggaagcgggccggctccttcacagggactagtgaccccgaggcagcccctgcccgcaccagcttctctggccgcagtgtggagttgtgctgtgccagccgcaagcccaccatggccgaagcacgggctgtctccaggaaggctgccaacacagccaccaccacgggtccccgccagcccttcagcagggcccgctcaggcagtgcccgatacacctccaccactcagaccccgagggctggcagctccagccgggctcgttcccgggcccccggcccccgggacacggacgacgatgaggaggagcctgacccttatggtttcatcgtgcagacggcagagattgcggagattgccaggctgagccagacgctggtgaaggacgtggccatcctagcccaggagatccacgatgtggctggggacggtgacacactgggctcctcggagcctgcccacagcgcctccctcagcaacatgcccagcacccccgcctcgaccatctctgcccgggaggagctggtgcagcgcatccccgaggccagcctcaacttccagaaggtgccgcccggctcgctgaactctcgggactttgaccagaacatgaacgacagctgtgaggacgccctggccaacaagacgcggcctcggaaccgagaggaggtgatcttcgataacctgatgctgaacccggtgtcccagctgtcgcaggccatccgtgagaacacagagcaccttgccgagaagatgaagatcctctttcagaacacagggagagcttgggaggacctggaagccaggatcaacgccgagaacgaggtgcccatcctgaagacatctaacaaggaaatcagctccatcctgaaggaactgaggcgggtgcagaaacagctggaagttatcaatgccatcgtggaccccagtgggagcctggacctgctcacaggaaacaggagcttggccagctctgcacagccggggctggggaagggccgcgtggctgcccagagcccaccctcacccgcctcagccgaggccctgctgccagccctgcccctgaggaatttcccacagcgggccagctgtgggcctcccagcctcccggaccccaccttcctccctgatgccgagaggttcctgatctaggccccagacctggccaggccagcctccctgtgcgtgtgcgtctctgccttccgtccgccgcacacccgcctgcctggccgcaggtggttctccctgaagacccccacatgtgccatatccctgtgggcgggtgcctcccacgcccttgccccctcgtcagctcccagccagcaccctactcaccctgtccagccccatggccacccccacccctgcctcgccccctacaggcctctgggcccagctcctggccaggctgctgccaaggtcaagccctcaagggcattaccccgcctcctcttcatcactgttatttttgtctttagctttaaaggaaagagttgttggtgccattgcaggtgccccctccaggcctgactggctccgccaggcactaacctgccataaccctttgtgctggcctgcggccaggcagaggaagagaggtcgactgtggggtcatttggtgccaaacatggaggtgggcaggctcacctgttcctgggactgtctgagatggcagggcacttgccctggtggctcccacctgaccccaggccttttataggcaggagccccactgcttccagcctctggtgccaacacagttgccaaacccattgagcttggggctgccctgtggaggcctcctgggtatggaccaggggcttgttgagagctgagccatgcacacaggtgcagacaccccccaactcccatgcacacggctagtccaggcgcctccacgctgcaccgtgaggactgcagggcatgtccccgtgaggggctatgggcctctgtaggtgggcttccaaggtcctgggtgcagccgggtgcatggcagcccttctggcgggggtgagcgcacgaccaaagtcactggaagccgggtttccggaagctcgcagcttggcctgcaccacacgccctccccttttggcttcacgccatcaggcctcaagtgggcatgggggcagggacgggcccaggaactgttgttttctcaggattctttcagctgggaacatggcaggtgagcagagcttggtgcctctgccgtggcccctgctggggcagcccgtgttgccggagcctctaagccaaagagcccgttggccgtggttggtgggggtggacgtgggggtgtcccacctggaccagactggcgtgggtgagctccacaccctgcctggcaatggtatgagagtcggacctggacagggccagctgctgggggagcggcactggggactggaggctggaagcgggtggtgtgtgtcccctgtttacttttagctgagctggggttgggtgtacgggttctgttcctctgagcctgcggcccacctgatgtttacgtgtgtgtgtgagggggggcgggggtggcaggtgtccccccctggtccccgccccaagagcctgctgtctgtatggaggaggtgctagcccggtccaccgggctgctgcccacccctgcatgccccagttgcccaccccgcctgcccctggacatgaagtggtcacgcttcatccacggctccttcccacccctcggcagtggctgtgcaatgttttaagttcacaagttcctgctcctccccacactgagctcctttgttcctccccctccagcctttgcctgggaactggtccttgtttgccgggcttctcggagggttcactgtacattcgttctcaggtggtcttgtggctgtctttcggaaaatggttattttatatgatttgtcatggaatttgttctaataaatcattcttctatcac

SEQ ID NO: 2763 - DNA, 3229 bp, Homo sapiens
attatcttacttttggttccctcagaagaaacagatgaaaatgatttgatcctggaagtaactgcaggagttggaggtggccttagacatgcatctgccagcattgggggttcagaagcctataggcacatgaaatttgaaggaggtgttcacagagtacaaagagtgccaaagacagaaaagcaaggccgcgtccatactagcaccatgactgtagcaatattaccccagcctactgagattaatctggtgattaatccgaaagatttgagaattgacactaagcgagccagtggagctggggggcagcatgtaaataccacggacagtgctgtccggatagttcatcttccaacaggtgttgtttctgaatgtcaacaagagagatctcagctgaaaaataaagagctggctatgacaaagttacgtgcaaaactgtacagcatgcatctagaagaagaaataaataaaagacagaatgctagaaaaattcagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccgattatgaatctttagtagaaattatttcccaaaaagtttaagttgatttgttatttatagactttcgtatcttagaaaaattctacagtacatccacatagggtgaaagtacccttactctcttgaaaaacgttgagttaacacagttggaggtaatatgcatattctgaagtcatagataatttacacagatctctctcaatgcattagcaaaaatcatacaatatacagatggtcctcgatttacattgtggttaattcccaataaacccatcataagttaaaaatgcatataacgttagcaacacagcagtctcctaattaatgacagcttgacttaacaattttccaactttaccatggtgtgaaagaggtatgattcctaagccctaaggagctcctcagcttgaaatggggctgcatccctataaacccatcataaagtcaaaaaatcctaaaacataagttggtgaccatctgtaatcatgatgtggtggtaaatcttggacgctaccttacaataactagacaaaggaaaatcatcctttgtcctgttctgtgtaaatatttaatgaatgatcaaaacttcagtttaaatattatgaaaaactttaaacataaagtagtagaaataagacagtaaatactgtatcctaatatccagtcaggatacagaaaccataccattaacttgaacagggataattttaatataaaaactgttaactgataatggtattaacttttaagagggatgaaagagagctatgatgtcctaggactgagagtaccccaggaaagaatacccttgaaagggtctccccttccccatggtgaagtcaggcctaatggagagagtggctacagcctactcagtgattgggaaattccctgtcttgccctgggccagagctggtgtaccgctggtggatcaggtcttacaagcaaagaacctcacactcccaactggtaagccagaagcctcttgctagggtgtgagcaaaacttggacaggaactctcagtagatgtttgtgtttgtcaagattctccagacaaacttccttaaaaggattggcttgtgttgttattattaagtctaacaagtccaaaagctggagtgtgaggcaggaggctggaaacccaggaaagctgatggtgcaaggtccagtccaaaggtatctgttggaggattctcttgttctgggaagaggacggtctttttttctcttcagaccttcacctgactggatcaagcccactaacatcgaggaggacagtctgcattactcagagttcactgattgatttaaatgtcaatctcatataaaacaccctcacagaaacacctagaataatgtttgaccttataattggaaaatcagagcaaaagttaaatctcaaaaaaaaaaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgagggattctcttaggactgggatgaaggcccataataaaagaggtttcggggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattcttgtctcttcggaagctaacaccatgctataataggcactaaatagatgtctaaaaacaccttaagtatttgtctagaaatctggtgcattgttcagaaagaaccaaaattcaaaataatttcaaagggcctaaagcactagttaatcaaaattcattagtttttaatggtactaccactctcaaatttaaaatgtcatcttacgttcctcttcctcgcattggatttattgctaaaacctggtaaacacttttaatccttttcaattccattaccactgctcttgtccagaattacttcgcagactaatagtcacctgacttctcccctgcatccgatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacatcca

SEQ ID NO: 2764 - DNA, 1476 bp, Homo sapiens; identical to SEQ ID NO: 1945

SEQ ID NO: 2765 - DNA, 999 bp, Homo sapiens
acagaagttaaacttctttccagggaagaagggcggggatgtcagggctggagagtgcccgtgtccttctgtgtgcattgggctccttcctccttaattctctgctttccacttttaggctgaactccagtgcacccagttagacttggagcggaaactcaagttgaatgaaaatgccatctccaggctccaggctaaccaaaagtctgttctggtgtcggtgtcagaggtcaaagcagtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagtaagcaggagctggagacgatggcggccatcagcaacactgtccagttcttggagatgtgcatgacatcacgttcgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccagaaaggggaggagcgcagcagttgcatttccggaaacaacttctcctggagcctccaatggaacgggaaggagttcacggcctggtacagtgacatggagaccccactcaaagctggccctttctggaggctcggggtctatattgacttcccaggagggatcctttccttctatggcgtagagtatgattccatgactctggttcacaagtttgcctgcaagttttcagaaccagtctatgctgccttctggctttccaagaaggaaaacgccatccggattgtagatctgggagaggaacccgagaag

SEQ ID NO: 2766 - DNA, 1184 bp, Homo sapiens
aaaagacttattgacagtgccaaagctcggtactggacacaacgagggacctgggtctacgataacgcgcttttgctcctcctgaagtgtctttggtccaacgttgttccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagagctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtaggaggagcaggaaataagattattcagctgattgaaggcaaagcctctgcttatgtatttgcaagtcctggttgtaagaagtgggatacttgtgctccagaagttattttacatgctgtgggaggcaagttaaccgatatccatgggaatgttcttcagtaccacaaggatgtgaagcatatgaactctgcaggagtcctggccacactgaggaattatgactactatgcaagccgagttccagaatctattaaaaatgcacttgttccttaaaggaaagtttcatttggccgggcgcggtggctcatgcctgtaatcccagcactttgggaggccgaggcaggtggatcacttgagctcaggagtttgagaccagcctgggcaatatcgtgagaccccatctctacaaaaatacaaattaactgggcatcctgtcatgcgcctgtcatcccagctacttgagaggctgaagcagaagaatctcttgagcccggaaggcagaggttgcagtgagctga

SEQ ID NO: 2767 - DNA, 885 bp, Homo sapiens
tttgatatgacgattagagcataacccgagtgacacgttgaattcgccataatcaaggaaaccttttccgggtggggatctctgaaattactcagataacagtgctgtgccaaaaacctgtggattttctctacaaaaattatcatgactgttatctttttgatggaaaagatgaagttcagcgaagaacaaatctacaacttggccagaagactgtagactttgccttcaaagagtgagcaaccctaattaacctgattttttgctgataatcactctcaatggaatcaaatcacaaatccggggatggattgagcggcactcagaaggaagcagccctccgcgcactggtccagcgcacaggatatagcttggtccaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccag

SEQ ID NO: 2768 - DNA, 2146 bp, Homo sapiens
gtaacgttcgggctccgtctcaggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccgatcatctgaaaccttttcttgatgattctactctccgatttgtggacaaactgtttgaggctgtggaggaaggccgaagctctaggcattccaagtctagcagtgacaggagcagaaaacgagagctaaagatcaaacagatgatggaggcagcaacacgacaaatcgaggagaggaaaaaacagctgagcttcattagcccccctacacctcagccaaagactccttcttcctcccaaccagaacgacttcctattggcaacactattcagccctcccaggctgccactttcatgaatgatgccattgagaaggcaaggaaagcagctgaactgcaagctcgaatccaagcccagctggcactgaagccaggactcatcggcaatgccaacatggtgggcctggctaatctccatgccatgggcattgctcccccgaaggtggagttaaaagaccaaacgaaacctacaccactgatcctggatgagcaagggcgcactgtagatgcaacaggcaaggagattgagctgacacaccgcatgcctactctgaaagccaatattcgtgctgtgaagagggaacaattcaagcaacaactaaaggaaaagccatcagaagacatggaatccaataccttttttgacccccgagtctccattgccccttcccagcgccagagacgcacttttaaattccatgacaagggcaaatttgagaagattgctcagcgattacggacaaaggctcaactggagaagctacaggcagagatttcacaagcagctcgaaaaacaggcatccatacttcgactaggcttgccctcattgctcctaagaaggagctaaaggaaggagatattcctgaaattgagtggtgggactcttacataatccccaatggctttgatcttacagaggaaaatcccaagagagaagattattttggaatcacaaatcttgttgaacatccagcccagctcaatcctccagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaagtgagaatttctaatttgatgcgagtattaggaacagaagctgttcaagaccccacgaaggtagaagcccacgtcagagctcagatggcaaaaagacagaaagcgcatgaagaggccaacgctgcccgaaaactcacagcagaacagagaaaggtcaagaaaattaaaaagcttaaagaagacatttcacagggggtacacatatctgtatatagagttcgaaatttgagcaacccagccaagaagttcaagattgaagccaatgctgggcaactgtacctgacaggggtggtggtactgcacaaggatgtcaacgtggtagtagtggaagggggccccaaggcccagaagaaatttaagcgtcttatgctgcatcggataaagtgggatgaacagacatctaacacaaagggagatgatgatgaggagtctgatgaggaagctgtgaagaaaaccaacaaatgtgtactagtctgggagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcct

SEQ ID NO: 2769 - DNA, 4073 bp, Homo sapiens
gccagctgctgcgcatgcgccggccggggccccgcccccatgcgccgcgcggctccagggccacgttccagggtcgggtttggtggattcctcagtccctgccgccgcggggcgccctgggatagcggcggggcctcctggtgagcgcgcgccggggcggcctccgggaagtgggagacgctgcgggtcctgggcccaggccttgggatgggcgggaaggcttggccgcgccgggctgtgggcactgcaggaggcccctgtgcaggtggagatcgccgcggccctggcgggactccttgctggctcttgggcgcgctgatgcccatcatctccctgagtttctgagccctatctctcatgtgtcagtggtcaccgccgaatccagacactccggccctgttccggaagagccctgatatccgtggctccatggcgctgtctgtcgataccatgcactctagctctcaaggaggaaaggttttgtggaagggaatagagacttggaataacagacctgtgctaattagagacaggaaagatggaacaaggggagtgacccttctccacccccatatcctaatgtgctctctctctatccagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggctgcagggtcttcaccggtttgtggcccgggaaaagataatgtctgtgctgagtgaatggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgacagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatcccaaa

SEQ ID NO: 2770 - DNA, 2394 bp, Homo sapiens
ggcttgaatcccggcgcctcagaggactatgaggcgggcgccaactgcttgggccgcagggcgggaggcagcgcgggagtggggcgttgaggggccggcctagcttggggctctggccttgcgtcttccgaccgaatcaccgctcctgagcccggtgcggggctgccgctatcgcctggccgtgggtgccggagcggccgggttgcgactcagcgttcttgggtgggcgcgggcggcgtctccgcggcgggcatcccccgaggccgccctcgggccatgatcgactccgtgaagctgcgccgcgacagcgcggcggacttcttctcccactacgagtacctgtgcgcgctgcagaactcggtgccgctgcccgccgtgcgcgcctgtctccgggagggcgtgctggatttcaacgccgaccgcctccgcggggtggactgggcgcctctgctgagcaccctcaagatcaataaagacctgcccttggtctccatcaagagcttcttccagccctggctgggggacacaggttctgacatgaataaattttgcagaagtcgtgttcctgcgataagatacaaagatgtgaccttccagttgtgtaaagctcttaaaggctgtttaagtatatcaagtgtgctaaagaacctggagctaaatggactaattctgagagagagggatttaactattctagcaaagggattgaataaatcggcttctttggtgcacctgtctcttgcaaattgtccaattggagatggaggtttagaaattatttgtcaaggtataaagagctctatcactcttaagacagtcaacttcacaggatgtaatctgacatggcagggagcagatcacatggccaagatcttaaagtatcagaccatgagaaggcatgaagaaacctgggctgagagtcttcgctataggagacctgatcttgactgtatggctggcttaagacgtatcacactgaattgcaacacacttattggtgacctaggtgcatgtgcttttgcagactctctcagtgaggatttatggctgagagctcttgacctgcaacagtgcggcctcaccaatgaaggagcaaaggctttgctagaggcccttgaaaccaatacaactctggtcgttctggatataagaaaaaatccactcattgatcattctatgatgaaagcagttatcaaaaaagtcctccagaatggaaggagtgccaaatcagagtaccagtggataacttctccatcagtgaaggaaccatccaaaactgctaaacagaaaaggagaactataattctaggaagtggtcacaaaggaaaagctactattagaattggattggctacaaagaaacctgtaagtagtggcagaaaacactcccttggtaaagaatattatgcgcccgcacctcttccacctggtgtgtctggtttcttgccgtggcgtactgcagaacgtgcaaaaagacacaggggtttcccattaatcaaaacacgtgatatatgtaatcagttgcagcaaccaggttttcctgtgactgtgacagtagagagtccttcatcctctgaagttgaagaggttgatgattcttcagagagtgttcatgaagtgcctgagaaaactagtatagaacaagaagcattacaggaaaaactggaggagtgcctaaagcagttaaaggaagaaagagtgataaggcttaaggttgataaacgagtcagtgagctggaacatgaaaatgcccagttaagaaatataaatttctctttgtctgaagcccttcatgcacagtcattgacaaatatgatcctggatgatgaaggtgttttgggcagcattgagaattcttttcagaagtttcatgctttcttggatctccttaaagatgctgggcttgggcagcttgccacaatggctgggatagatcagtcagattttcaattactaggtcatccccagatgacttctactgttagtaatccacctaaagaagaaaagaaggcgcttgaagatgaaaaaccagaaccgaagcagaatgccctagggcaaatgcaaaatatccaggtttctatttgtatgcagtcagcttacaatgaaggaacactaatgaagtttcagaaaattacaggtgatgctagaattcctttgcctctcgactcctttcctgtcccagtttctactccagagggcttaggaacttccagcaacaacctaggagtcccagctactgagcagcggcaggagtcttttgaaggattcattgctagaatgtgttctccttcaccagatgcgacttctggaactggaagtcaaagaaaagaagaggagttgtccagaaatagcagatcttcttcagagaaaaagaccaaaacaggaagccactaa

SEQ ID NO: 2771 - DNA, 4285 bp, Homo sapiens
gcacttccgggccggccgattccgcgcgtctccgcccatcatggcgctcgtgccagtgtcccgtgggctacccactcctgtcatgtcctttgggctggtgcaggccagatcttctagggccgtagccctgagaggagcgcctggagaggaaacggcgcgccatgcacctcacacggcccctcagacctcacggcgaggccctatcagggtaatggtgtccgccggactcgcacaacactccgccggactcgcacaacactccgccgcactcgcacaagactccgccgcggcgacctctactgaaagacccccagtcctggtgtcgcccgaaggcccaggaaaccgtgcttccgcgcttctcccccatttaccccagggtcgcaaaacatctcaccgtagttgaagccagcaagccggaccaggcgtcccggccaagccacgtgcgcgccccgcgccgcgagtgctcgccccgcccctagggaggagccggccgacccccggccacttagcagtgccgcagccgacggggtgcggttcggcgctcccaggttcctttcctcactgcacgctcttgcccctcctcttttctctcctgcccgtgttcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcagaagaaaagccacgccacttaagtttggcagagatgacgggcagccctttgcatagagcttttccctggacttggagttggtctttccctgaggatctaggactttgggcccctctgggctacctccaaggaatcagtcacctctgttctgctgagtctggagaccaggtggtggggtggacggggcataaggaagagtgatgcatacacagtgctagagtacagaatgcagtaagtgatccatgggggcagagagcaaggtaccgcatgatcagaagagagaactagtgctaccgccttgcttgtctagtacattaaaacttacaagtcatgttcacacttctctgctcacttagttttttaaacagtcctctgtgtgtgtttatttccctttatgcctgagaaaaccagagaggtaaagtgacgtgcccaaggtcagataccactaagtggtgatacagagtaccagacatagtaattccaagttcctaccctctctgtcttcccccaacccgtgccccgtcgtcctctggaacatgagactgccccagagcagcaggaggggatagataggatggcctggcagtcgagaaagggaggccacttcagggaggtagcaatgcagtggaaagtgaccctcacctccagatgggggctgctcagacactgccaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcagcagcattttgtggctcactacctaagggcccagcaggaggaatacgcagttgagggcctggagtggtcattcatcaactaccaggacaaccagccctgtttggatctcattgagggaagccccatcagcatctgctccctcataaatgaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaaggaccctatcccacctgagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgaccaagtttaactccatatgaagtgtaagcttgatatcgtttatgatgtctatcaactgtaccaaaagtaaaacatttaaaaac

SEQ ID NO: 2772 - DNA, 2268 bp, Homo sapiens
gttgtgaccagagcggttgcgggctgagcggtttcgagccggcgtcggggagcggcggtaccgggcggctgcggggctggctcgacccagcttgaggtctcggcgtccgcgtcctgcggtgccctggggtctcccgaggaccttgtacccgcgcggcttccttgggctggctttggacgacgctttcgccttcctgctgcctaggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggagctggaggttatgccgacaatgacatcggagccgtctcaaccacagggcatggggaaagcatcctgaaggtgaacctggctagactcaccctgttccacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcacttcggaattgatcctgacgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcgatgagagaaatgcccgtattaggaggattacttgagcccaggaggtcaaagctgaggtgagccatgattactccactgcactccagcctgggcaacagagccaggccctgtatcaaaaaaaaaaaaaaaaagaaaagggaaaaaagaaagaaagcagcagcatgatcctgacatgacagatgtgggagacccacagcctgcagacactgtgggctggaaggtgggaagggaggggccggtggaggtggagctgtttgaaagtgacacagcagcagtagaagcagtggtgggcgaagcccaggtgaccctcagaacgttgcacaagaacatcagggaaaagaaccagaatcctttaaggaaaatgttcttcatgtatgagagactaaagtgatttttctaagaaagttcagcccttctctgacttacctggacatttctagatacttccaaaggaccctctgggaatccatagcttcctaatctggagatgggaggtcataagggagacgctgtggggttccttgaagtttcttgggttcacagaggagccccctcacttggtgttctcccgtgagccagcctccacctgccaaagacactctggtcctcgtatagtgagtaatggggctcagggcctctccaacaacagagaggagctgatgctgtagggctgaccccgtgacttcctgagtcctcaccctgtccagtgctttgagattcttcccacctccccatcctcaccagccggatcgggcgctgtgcagtgtggtcagcatggtgaagaaagtcatttcctcggtgggcagtattcctctttatctctcattacactggaaatgttatttctgctgtatcatccgtgctcaacgttttagtctgtcaggctcaccttctctctggaaagaatttgcttaacttgacattccatgtgccgctaataaaatatattttgaaag

SEQ ID NO: 2773 - DNA, 1220 bp, Homo sapiens
gaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggtggtgattctagatgtccgggttccctgcacacctgtcgccaggttaaacaaccatcgagcatgtgtcaatggcattgcttgggccccacattcatcctgccacatctgcactgcagcggatgaccaccaggctctcatctgggacatccagcaaatgccccgagccattgaggaccctatcctggcctacacagctgaaggagagatcaacaatgtgcagtgggcatcaactcagcccgactggatcgccatctgctacaacaactgcctggagatactcagagtgtagtgttggtggcgctgtgcccacgaggcaggggcttttgtatttcctgcctctgccccacccccaaagtaagaagaaacatgtttccagtggccagtatgtctttcattgctttgcacccactgttaccagaagctgctctaggagttcctggccagtcaccccatcgccctctgtggcagactcagtgctgtgtggcgcctcctcagcccagggctgagttttaagattttctctcctttcctcttctcctttggttcctcaattaaaaaatgtgtgtatatttgtttgtcaggcgttgtgttgaggagcagttcacgcactggctgtgtctattcctctgcccaggtgtctctgtttgctgcccaaggcagcagttcatgtctcgtccatgtccatgttcgtgttagcacttacgtgggaacaaataccaatttgtcttttctcctagtatcagtgtgtttaacaaattttaactttgtatatttgttatctatcaggctaatttttttatgaaaagaattttactctcctgcttcatttctttgtcttatagtcctccctctttgcaccttcttctcttccctcagtgcctggagctggtactgggcccctg

SEQ ID NO: 2774 - DNA, 3772 bp, Homo sapiens
ggccgtgcgagaggccgagcttgctgcattgcagccgccgcggcgccgctcggctcttcactcccaacaatggcggctccgagcccgagcggcggcggcggctccgggggcggcagcggcagcggcacccccggccccgtagggtccccggcgccaggccacccggccgtcagcagcatgcagggctttcagataaacttctgtgaaaaggcacaaagtaaacgcaaagcactgaagttgaattttgcaaatccacctttcaaatctacagcaaggtttactctgaatcccaatcctacaggagttcaaaacccacacatagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggttttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatg

SEQ ID NO: 2775 - DNA, 993 bp, Homo sapiens
ccagccactgcggcaggaagcaagaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatctacattagctcagattatgtatttgatggaacaaatccaccttacagagaggaagacataccagctcccctaaatttgtatggcaaaacaaaattagatggagaaaaggctgtcctggagaacaatctaggagctgctgttttgaggattcctattctgtatggggaagttgaaaagctcgaagaaagtgctgtgactgttatgtttgataaagtgcagttcagcaacaagtcagcaaacatggatcactggcagcagaggttccccacacatgtcaaagatgtggccactgtgtgccggcagctagcagagaagagaatgctggatccatcaattaagggaacctttcactggtctggcaatgaacagatgactaagtatgaaatggcatgtgcaattgcagatgccttcaacctccccagcagtcacttaagacctattactgacagccctgtcctaggagcacaacgtccgagaaatgctcagcttgactgctccaaattggagaccttgggcattggccaacgaacaccatttcgaattggaatcaaagaatcactttggcctttcctcattgacaagagatggagacaaacggtctttcattagtttatttgtgttgggttcttttttttttttaaatgaaaagtatagtatgtggcactttttaaagaacaaaggaaatagttttgtatgagtactttaattgtgactcttaggatctttcaggtaaatgatgctcttgcactagtgaaattgtctaaagaaactaaagggcagtcatgccctgtttgc

SEQ ID NO: 2776 - DNA, 3195 bp, Homo sapiens
agtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagttcaccatttcaggtcactgctggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttca

SEQ ID NO: 2777 - DNA, 712 bp, Homo sapiens
tctcggtctgtccgctgggggcgcgcgcggtgtgtggcaggcggcagcggcgctggcggccgagtgcgcttgtcacgcgtggcggtgcgtggttgctaggggcgcctgaggctgccgggtagcccagcaggccgagggaggaagtagcgtggagccggtgccgagccggggcgaagctggatcccctagatagactgtcttcaagctcactgatattttcctctgcttgatccattgtgctgttgagagcctctagtaaatttttcaggtcactacctctttttcaacactagatggcatcttggccccagactgacagacttcaaggatgcagctgctactaccggaggtgtgtggcaccttacctcagcaaggccatgagaccgtgtggccatgatgtgggcccctcatggcctcagcaggaacacagcactatagtattggcctccgccagaaaaacagcttcaagcagagtggtccctcaggcacagtacctgccacgccacctgagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcagt

SEQ ID NO: 2778 - DNA, 2623 bp, Homo sapiens
tgaggggccggcctagcttggggctctggccttgcgtcttccgaccgaatcaccgctcctgagcccggtgcggggctgccgctatcgcctggccgtgggtgccggagcggccgggttgcgactcagcgttcttgggtgggcgcgggcggcgtctccgcggcgggcatcccccgaggccgccctcgggccatgatcgactccgtgaagctgcgccgcgacagcgcggcggacttcttctcccactacgagtacctgtgcgcgctgcagaactcggtgccgctgcccgccgtgcgcgcctgtctccgggagggcgtgctggatttcaacgccgaccgcctccgcggggtggactgggcgcctctgctgagcaccctcaagatcaataaagacctgcccttggtctccatcaagagcttcttccagccctggctgggggacacaggttctgacatgaataaattttgcagaagtcgtgttcctgcgataagatacaaagatgtgaccttccagttgtgtaaagctcttaaaggctgtttaagtatatcaagtgtgctaaagaacctggagctaaatggactaattctgagagagagggatttaactattctagcaaagggattgaataaatcggcttctttggtgcacctgtctcttgcaaattgtccaattggagatggaggtttagaaattatttgtcaaggtataaagagctctatcactcttaagacagtcaacttcacaggatgtaatctgacatggcagggagcagatcacatggccaagatcttaaagtatcagaccatgagaaggcatgaagaaacctgggctgagagtcttcgctataggagacctgatcttgactgtatggctggcttaagacgtatcacactgaattgcaacacacttattggtgacctaggtgcatgtgcttttgcagactctctcagtgaggatttatggctgagagctcttgacctgcaacagtgcggcctcaccaatgaaggagcaaaggctttgctagaggcccttgaaaccaatacaactctggtcgttctggatataagaaaaaatccactcattgatcattctatgatgaaagcagttatcaaaaaagtcctccagaatggaaggagtgccaaatcagagtaccagtggataacttctccatcagtgaaggaaccatccaaaactgctaaacagaaaaggagaactataattctaggaagtggtcacaaaggaaaagctactattagaattgtaggattggctacaaagaaacctgtaagtagtggcagaaaacactcccttggtaaagaatattatgcgcccgcacctcttccacctggtgtgtctggtttcttgccgtggcgtactgcagaacgtgcaaaaagacacaggggtttcccattaatcaaaacacgtgatatatgtaatcagttgcagcaaccaggttttcctgtgactgtgacagtagagagtccttcatcctctgaagttgaagaggttgatgattcttcagagagtgttcatgaagtgcctgagaaaactagtatagaacaagaagcattacaggaaaaactggaggagtgcctaaagcagttaaaggaagaaagagtgataaggcttaaggttgataaacgagtcagtgagctggaacatgaaaatgcccagttaagaaatataaatttctctttgtctgaagcccttcatgcacagtcattgacaaatatgatcctggatgatgaaggtgttttgggcagcattgagaattcttttcagaagtttcatgctttcttggatctccttaaagatgctgggcttgggcagcttgccacaatggctgggatagatcagtcagattttcaattactaggtcatccccagatgacttctactgttagtaatccacctaaagaagaaaagaaggcgcttgaagatgaaaaaccagaaccgaagcagaatgccctagggcaaatgcaaaatatccagtttcagaaaattacaggtgatgctagaattcctttgcctctcgactcctttcctgtcccagtttctactccagagggcttaggaacttccagcaacaacctaggagtcccagctactgagcagcggcaggagtcttttgaaggattcattgctagaatgtgttctccttcaccagatgcgacttctggaactggaagtcaaagaaaagaagaggagttgtccagaaatagcagatcttcttcagagaaaaagaccaaaacaggtgaatataccaaaaaacactctgataagcaacaccctggaaaggacctgcattcctgatctgactgtcctgaaaaccagaaaagcaaagaaactagggaaactagttctttggttaatgaaccaattaaaagtaggtctttgaaaaaatacgtttctgtcaagaaagaaaatagaatagtgactgtttcatccaagacaaataaaagtaaatccagtccactagaacattctgaaagtgatactcttggatgtgattttgaatttcaagaaagcatccattctctatcacacctttcatatgactaaatcttttgaaactatgtttttacctttaaattttaataaattttcttatgtttttattatggca

SEQ ID NO: 2779 - DNA, 2015 bp, Homo sapiens
cggctgtacgctaccacagcttcccaggccgcgggtgctgattgcccgcctgcccgtgggtcatggcctgccagcagtcgcggtaccacagcttctcgtccgcgtcgagattacagccacggccttcaggagtgaccatagacgaatcctttctcacagaagacaagagcacccagaatcgcaagcttcttcagaaacgaaggacgctggagctgccagcagcacccctttcgcactgccaagccccagtacttggaggaactggaaaactacctacgcaaggagctcctcctgctggacctgggcacagattccacccaggaactaaggctgcagcccaccaaagggagaagattcgggctctggagcccctgaaggccaagcttgtcactgtgaatgaggactgcaatgagaggatcctggccatgagagctgaggagaaatatgaaatctccctgctcaagaaagagaagatgaacttgctaaaactcatcgacaaaaagaatgaggagaagatttcattgcagagcgaggtgaccaaactgaggaagaacttggctgaggagtacctgcactacctcagtgagcgagatgcctgtaagatcctcatcgcagacctgaatgagctgcggtaccagcgggaggacatgtcattagcccagtcgccaggcatctggggggaggaccctgtgaagttaaccctggctcttaagatgacccggcaagacctgacccgcacgcagatggaactcaacaacatgaaggccaactttggagatgtggtccccaggagggactttgaaatgcaggagaagaccaacaaggatcttcaggagcagctggacaccctgagagccagctacgaggaggttcgcaaggagcatgagatcctcatgcagctgcacatgagcacgctgaaggaacgggaccaattcttctctgagctgcaggagatccagcgcacttccacgccgcggcctgactggaccaagtgcaaagatgtggtggctgggggcccagagcgctggcagatgctggctgagggcaagaacagcgaccagctggtggacgtgctcctggaagagattggttcggggctgctgcgggagaaagacttcttccctggtctgggctatggggaagccatccctgcttttcttcggtttgatggcctcgtggagaacaagaagccaagcaagaaggacgtggtcaacctcctcaaggatgcctggaaggaacgtcttgctgaggagcagaaagagacgttcccagatttcttcttcaatttcctggagcatcgctttgggcccagtgatgccatggcctgggcttatactatttttgaaaatatcaagatcttccactccaacgaggttatgagtcagttctatgcagtcttgatgggaaagcggagtgagaatgtgtatgtcacccagaaggagacagtagcccagctgctgaaggagatgacaaatgctgacagtcagaacgaggggctactaaccatggagcagttcaacactgtcctcaagagtaccttccctctcaagacagaagagcaaatccaggagctgatggaggcagggggctggcatcccagcagcagcaatgcagacttgctcaactaccgctcactgtttatggaggatgaggagggccagagtgagccctttgtgcaaaaactctgggaacaatacatggatgagaaggacgagtacttacagcagctaaagcaggagcttggcatagaactccatgaggaagtgactctgcccaagctgcgagggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcaggtgattgacatcaggcgtgtgggacctcgagagccagagcctgcaagctaggaacttgtgggcagcctgcgt

SEQ ID NO: 2780 - DNA, 603 bp, Homo sapiens
gtgcaggagcgggacccggaacagaccgccgtgagagaggaggggcgccggccgggattcgcggcccggagctcgggaccggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaagga

SEQ ID NO: 2781 - DNA, 2678 bp, Homo sapiens
caaagcagacctcacctcccactaccagcttgaagtcacagcagccagaggaaattctgccaccattttcccaggtctgcagcccctccagctgggaacctgctcctggagccatccctctgcaaacagagagcccagagtgcctcggggaaaattggctgaataaaagagcgatcaggacgccacggctccgcctgaagcgatggcccagccctacccccccgcccagtacccccctccgccacagaacggcatccctgccgagtacgccccgcccccaccgcaccccacgcaggactactccggccagaccccggtccccacagagcatggcatgaccctgtacacaccagcacagacccaccccgagcagccaggctccgaggccagcacacagcccatcgccgggacccagacagtgccgcagacagacgaggcggcacagacggacagccagccgctccacccctccgaccctacagagaagcagcagcccaagcggctacacgtctccaacatccccttccggttcagggaccccgacttgcggcaaatgttcgggcaattcggaaaaattttagacgtggagatcatttttaacgagcggggctccaagggttttgggtttgtaacttttgaaactagctcagatgctgaccgagcccgggagaagctgaatgggacgatcgtagagggacggaaaattgaggtcaataatgccacggcccgagtgatgaccaacaagaagacggggaacccctacaccaacggctggaagctaaatccagtggtcggcgcagtctacgggcctgaattctatgcagtgacggggttcccctaccccaccaccggcacagccgttgcctaccggggcgcacatcttcggggccggggccgggccgtgtataatacatttcgggctgcgccacccccaccccccatcccgacttacggagcggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatgtgaaaccttccaccgtttccttctcggaccatgaagggcaaaaacaaaaaaacaaaaaaaatcacaaaacaaaaaaaacaaaaaaagatgttaagatccaagcaacaaaaaaaaaaccaaccaaaccaagaggcatccaaccaagtccaagtcccgcgtcctggccacacgcccgcaccgagggagcacgccggcaggggcgccgaggagcggccccaggacaggacggccccaccgcgtcctggctggcagcacagtgggaacacgcccctccgtctcaggcagtgggggagttggaggggaaggggcctcccttgtgggacccgtggggggctctgttttccatccagtcttcctttcccagcccccaactcccaagacagacagtgtggagcccagcggcggcggagcaggcccgggcctgagcaggcaggcgctgctagcaagacttgatctttgtggccagctgtgccagggggccggcggggctgaggggtgcgggcagctttcatcccaggggctccactgggccccgtcaccctcctgtcgcgtcccctgcgtcccacctccctcctgcccggcagtcccgcccgtgcccccagcctggcgaggaagccgtccaacagtagccccggggccagctcccaacagaaagggctgacgtggctccaggactcaggggcgctccatgggaggacgaaggaagcccagccagccaggagccactcctcacacctccaagtgtggccaagtgggccctgaggccaaggacttacttgctcttcctggccatctctccctttctggaggaggcccggggcctgtgtacaccaaggctgacctcgtgctgcctgctgggacccagccctccctgccgctcccctgtgagcccagtccaccgtgggcgcccagggccagggacgggccagcgcccggctgcatcgcgaggttgggagtcacagtggctgtgggcctggacgggcacagccagagcaggggcccatgggaagggcaagggatggggaagcctgggccggccccttccctgctcccaaggcaggtgtccaggtggcgggagcagcaccaaggacagccaggcttacccggtgggaggagcaggagcagagcaggtggcagggaggaacccctggcgaggcagggagcactgaagtagggaagcagcaaaaaatacaggctcccaacgtggctccactgtctcatgaagtgtcaaaaatttaaaaatacacctcactttctattcagcatcagctattgaaatggaattctccttttctattcccgttgtacatagccccacgccctgcctccggctttgtcctctgtacagagccccctgtcccctctgctgttccggacccttttcttgcagcagctcaaccccccgactcactcagatccccaggactgcagccgagccccgggcttcctttcttaccattctgtatgcttccaaggtgtgaccattcaaactaacagtattattaagattattaataaagatttctttcttcaaaccagg

SEQ ID NO: 2782 - DNA, 556 bp, Homo sapiens
agaagcaagggagtagacaaaatgattctcttctttcttgcccctcagagagacctgagacaccctgaatcccactgtaatctccttggtgccattggtaactctgccaaagtccatctctaggtgacatgaagtctcttagaaattgaggaccaaattgcgctctgcagctctgggctacttcccatctcattttgtgtccctattttcgtatctgtattagagaggtgatctggtgccagctggtggaacagtgggtgatggcgtccctgctgcaagaccagctgaccactgatcaggacttgctgctgatgcaggaaggcatgccgatgcgcaaggtgaggtccaaaagctggaagaagctaagatacttcagacttcagaatgacggcatgacagtctggcatgcacggcaggccaggggcagtgccaagcccagcttctcaatctctgatgtggagacaatacgtaatggccatgattccgagttgctgcgtagcctggcagaggagctccccctggagcagggcttcaccattgtcttccatggccgccg

SEQ ID NO: 2783 - DNA, 3478 bp, Homo sapiens
aacagaccgccgtgagagaggaggggcgccggccgggattcgcggcccggagctcgggaccggagtcaggaatggagagaagggtaatggtgttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagctggtggtgtctgtcgattgactgagtgctggagctggcagccctgtgcaggctgccacctttgcccctttactgtgcttgctcctgactctacgtcgcgtctccaaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttctctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 2784 - DNA, 682 bp, Homo sapiens
ggaaacctgttgagatcacagagaatatactgacggcataaaagggcagaaccatagcagggtgcgcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccgg

SEQ ID NO: 2785 - DNA, 795 bp, Homo sapiens
cggcctgggcgtctcgagaggtgagagagttggcggcgaggtctcggcggctaagcgagcgtcggcgactgtctctccgcgagaggaggcaagttggggtccaggctccaaagccggtggccgcgtaccgcggtggagccgctgtctttgaggtctgaggagagaacagtgatatcctgagagaagatgggaaagggctgcaaggttgtggtttgtggattgttatctgtggggaaaactgcaattttggagcagctcctttatggaaatcatactattggaatggaagattgcgaaacaatggaagatgtatacatggcttcagtagaaacagaccgaggagtaaaagaacagttacatctttatgacaccagaggtctacaggaaggcgtggagctgccaaagcattatttttcatttgctgatggcttcgttcttgtgtacagtgtgaataaccttgaatcctttcaaagagtggagcttctgaagaaagaaatcgataagttcaaagacaaaaaagaggtagcaattgtggtattaggaaacaaaatcgacctttctgagcagagacaagtggacgctgaagtggcacagcagtgggcaaaaagtgagaaagtaagactgtgggaggtgactgttacagatcggaaaactctgattgaaccattcactttattagccagtaaactttctcaaccccagagcaaatcaagctttcctttgcctgggaggaaaaacaaagggaactctaattctgagaactaaaaatcagtaatttccacaattgtatgttga

SEQ ID NO: 2786 - DNA, 370 bp, Homo sapiens
ttctcaagttcctgccaatcctcaatgcataacagatctcaaggcttttttttcagtagttgccacccccaaaaccatgtctcttatggctgtcaatcaccgagctttattttttgtcgctgtcaatcactgaattttgtgtccaggacctgctatcccttgagctatttctcctatggtaatcaaactataggttctatatccaacagcttcagatccctgaattatgtgtctcatagtttccaacctatttccttcatgcacagcagtttccaaccagcttgttctgattttgtgggttggcaatctccatttcttagaagaacatgctgaattgtcttttcagtgtcttgccctgacagcgttttac

SEQ ID NO: 2787 - DNA, 941 bp, Homo sapiens
aagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgt

SEQ ID NO: 2788 - DNA, 3938 bp, Homo sapiens
accgagaagaagatatttaccagtttgcttactgctacccatatacatacactcgcttccaacattaccttgacagcctgcaaaagagaaacatggattacttctttcgggagcagctgggccagagtgtgcaacaacgaaagcttgacctcctgacgataaccagccctgacaatctccgggaaggggcagagcagaaggtggtattcatcacaggacgagtccacccaggggaaacaccctcatcatttgtgtgccaagggatcattgacttccttgtaagccagcaccctattgcctgtgtcctccgggaatacctggtcttcaagatcgcaccaatgctcaatcctgatggagtctacctgggcaattacaggtgttctctgatgggatttgatctgaatcgtcactggctggatccctctccatgggtccatcctaccctgcatggagtgaaacaactcatcgtccagatgtacaacgacccaaaaacaagcctggagttttatattgacatccatgcccactccaccatgatgaatggcttcatgtatggcaacatctttgaggatgaggaacggttccagaggcaggccatttttcccaagctcctctgccagaatgctgaggacttctcctattccagcacatcctttaaccgggacgctgtgaaagcaggaactggccgtcgcttcctcggtggactcctggaccacacttcctattgctacaccctagaggtctccttctacagctacatcatcagtggcaccacggctgctgtgccctacactgaagaagcctgtatccttagtccccacccagccttgggccagccctcatccagccgagagtatccaagtctgacaggtcaggaattaggcccccagctcaggtaagggctgagactctcaggtgaggatggaggtgcttcttcttctggtggcgtctttggattgtccagtttgcctcagcccttagtatgatactcctaccccaattgccatgctccaaatctttcccaggccagccggacccatggcctgcccatatcttactctgcttccatctctctcccctctcttctctcatgatgcagtgagtctcctgccatctaagctatgcaagtccacaggctggatgaccatccccagggttgctgaggaagagcttgatgatcttgactccttctaaccctgaacatacaaaaacatatgttctcttttcatcttttgtctaacctatcctctcccactttctcttccctctactcactatttccccttctacttacttttctcacccttgttccctctccttctatgccctcctcctccctcctcacctgtcctgtgcttctctttccttacttctttttccccctcctcccctcctttctgtcctctctctcatcccatcctccttttctttctctcctctttgcctgtcttctgtcttccttgtctttcccctctcatcctctgtgcatctttctctctgcctttgcatttcctttgacaaattccttttcctcttagtttcttcataaaatttctctgaaaactccaaagccttccatgatgaaattagaagttattttctagtttgcctaattttttaaggattaggtagtaactctagtttcccgagtgttgattttaatatcaaggtcactgcatcagagctgtaacagatcgtggcagattctgctttccttgatcctttgttttcgggttgatctatgtctcctttcctaacacttagttttctcagagaagtggagggaggaggaaggaactttagatgaaatgaactctgtatttctgcaaattccccctccctggaggtagaagtgctcttttagcattttttcaacccttggtgagtgtttatggaattcctctgtgcaggaaaacatcttttctgaacgtggcatgacttagggctagtcccaccagccaactgcaacttagtggctctgtttgtatgtgtgtttgggagggttgggggtatggtgtccaggtaccttgccaggaacatcggaagtagggcaatggccctagaaggaggggctgtcagggggtaggccaggtgttagagcaatgttccacatcctgttggacacagagatattatgattggaactgagagttccctatgtacagtcatcaagactgagggtcatcttgcagtctgctttaatacccacctgactcagcaaggccaagggagtaggctctgctctgaggaagagggtctgtgggttccaaagtcctggccacctgttatgtgccacattgcccctcttcatgccccatacacaccttagatgatgcatatggcctatgccttctccagaatctgctaactcctataacacatgcatatgcttcattccacattgtacttgctttgctctcccataatattatggcaaagggacagagagctgcctggaataagagtttgagcttgtgcactaaaggggattctgcaacccttattcatagtgagatgagggtccctccagaggaggcctgcccttagtttgttgttttttgctgtccaatctgacaggctctcctaccttttcttagcacttctgacatgcttctgtcttagaagaaaatgtgtttcttagtagaaagcccacccttggttcaggcccaaggtttccacccctcaacagccaacactcatttatcaaaagtaaacacagcattagtacataccaggaatcataaaaggcacctagggtaaaatactgaataaaaaggcatgattcctgactcacagaactttcagtctacttggggagacagaaaagggaagagataattacaatgtatgtgataaattctggtggaggaattccagaaggctctgggacattttcatttgacaagtatatattgagtgcctgtcataggtcaggtaaagttctaggcacagggaatgtaacagagaacatactaaagacaagaatgtctttacatgggggaaagagggaactcacacgcagtcctaggagtcagggaagatttcccaggaaaagagacatctaaactgagattttttgtttgtttgtttttgagatggagtctcactctgttacccaggctagagtgtagtggcatgatctcagctcactgcaacttctgcctcctgggttcaagcgattcccctgcctcagcctcctgagtagctgggattacaggtgtgcgccaccatgtccggctaatttttgtatttttagcagagatggggttttaccatgttggtcaggctggtctcaaacttctgacctcgtgatccacctgcttcggcctcccaaagtgctgagattacaggtgtaagccactgagcccggcctaaactgagtttttaatatgaactagtcaaactgggtgagggtgttgttgaagggaggatgtggtagacagagaggggagtacagaaggtatgggcagaagctgtaagtggtcccttagggctgaaggacttcagactcaatgataagtctgaagtggaaagatgtaagaagtttgatcttgaatgtagacaatggaaggacagattcgagggggccagtattgtagacagggacatgcattaggaggctgttataaaaatccaggtgagaaataatccaggccaagaccagagtggtggctgtagaatacttagaatgtggaactgagaagacttggtaattgactatttgggagtggcgacagggaatgggagctcgtgattggaaggggttaaggtgagtagagaggctatgcacaagctgagcaggtcgtgatactgatggacctaccctgccttgttctgtcctctagaggatgagaagaggaaacaaactgcaccagggaagctcaggccgattcaatgcatgcaagggtgatttaacctgggttctgtttgaaatactt

SEQ ID NO: 2789 - DNA, 1728 bp, Homo sapiens
cgcgggggcccgaccaccgcggggccgggacgcgatggcggcggcagagcccgcgagctcgggccagcaggcgccggcagggcaggggcagggccagcggccgccgccgcagcctccgcaggcgcaagccccgcagccgcccccgccgccgcagctcgggggcgccgggggcggcagcagcaggcacgagaagagcctggggctgctcactaccaagttcgtgtcgctgctgcaggaggccaaggacggcgttctggatctcaaagcggctgctgatactttggctgtgaggcaaaaaaggagaatttatgatatcaccaatgtcttagagggaattgacttgattgaaaaaaagtcaaaaaacagtatccagtggaaaggtgtaggtgctggctgtaatactaaagaagtcatagatagattaagatatcttaaagctgaaattgaagatctagaactgaaggaaagagaacttgatcagcagaagttgtggctacagcaaagcatcaaaaatgtgatggacgattccattaataatagattttcctatgtaactcatgaagacatctgtaattgctttaatggtgatacacttttggccattcaggcaccttctggtacacaactggaggtacccattccagaaatgggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcagcaggatctattagtggagatatcattgatgagttaatgtcttctgacgtgtttcctctcttaaggctttctcctaccccggcagatgactacaactttaatttagatgataacgaaggagtttgtgatctgtttgatgtccagatactaaattattagattccatggaaacttgggactgttatctacctctaactgtgtaacattttagacttcttaataacctaaatatttaaaataatgaatgtaacaccttttttagttcactgattctgaagtgttcttccctaatactttctttacttcacaaaacttcaaccataaaaacaaagggctctgattgctttaggggataagtgatttaatatccacaaacgtccccactcccaaaagtaactatattctggatttcaacttttcttctaattgtgaatccttctgttttttcttcttaaggaggaaagttaaaggacactacaggtcatcaaaaacaagttggccaaggactcattacttgtcttatatttttactgccactaaactgcctgtatttctgtatgtccttctatccaaacagacgttcactgccacttgtaaagtgaaggatgtaaacgaggatatataactgtttcagtgaacagattttgtgaagtgccttctgttttagcactttaagtttatcacattttgttgacttctgacattccactttcctaggttataggaaagatctgtttatgtagtttgtttttaaaatgtgccaatgcctgtacattaacaagatttttaaaaataaaattgtataaaacatt

SEQ ID NO: 2790 - DNA, 4128 bp, Homo sapiens
ttttataccagttgcctcctcatcttttactgtctcgttctttttctgcaggaccgttgtttgctctcaacggcagttgctggggctaacagaactggctgttgggagagagaggcgaggcaacgccgcccggccctgccattccattttactgcttaactcaacctggagtgtcaggacctattctcctgcattctcgctgcactatacgggggagccaagtcactctgtactcactggacagccaggctgggtggaatagggttctagagtggagcaggggctctgccctttatggcgactttctaaaagattagcatcagtgtcttttgacagtatagcatctggggtgggacgcggagaggaggctttgcttgctaaacggcttctttctccgccggtgatctggatttgtttcctcggccccctccccccgctcctttctttctcccctcccgcctttagcaaagtgacacaggcgacacctgctcgcttgtgttcgatgttggaactcgcacctcctcggtggtgacggtgccagggcactgctaccagggggacatcggcgggtttcccttccttccagcccacgatgcctagaagggcagcgggtgggctgcgtggggctctgcccgcagcacttcgaggcgggattgaggggctgaagctggccaggagttgctgctaagtggattcgagtggaaggcgccaagtctccgcgagggcaccagcggggacctatctgcgagcagtgggaacaggggcacctggacggaggaacgcgggcgtctggaggggggacatcggctgagctcagagcctctcctccttcctgtcccgagcttcccagcaactccgccacgttggagacccggtacctgcgagagccagggaactcgagaagtgcgtggccgaggctgctttcctgaaggtgaatcattctgtccaattgcctttccccagagaacaagagggagggcgggagagagggaacggaggatgtgtgagtgtgtgtgtgtgtgagagggagagacgacgtgaggcgagaggaaaagtctttagtcggccttaaaagcaaacaaatcagagatggaataagagcggtaattgcagcaagaccgccttgattcttgcagtccagggagctgagcgcaccgcgcgcatccggcgaggacaggaggcgaccgcgggcgctgccaagggctgcgggactttggcttttcctcagtaaacaaatcttttgattactttgacactgtggaataaagaagcggggagaaggatcaggctcaccttcacccgcttcagggggattccagcttggatgtcagattcctgaaccgtctttgccatcggaggaggaaacacatccacacacgcgcgcgcacactcgcacgctcagggccacactcacacgccgccctccacgatcacacagcaccagacttcggttccctatgcccctggatggtgacggcggattggcatcttggaagcgatgcgagagcgataaggctggcgccggcccgcaaaagctgcaggagcatcgctaggtgttgccgccaccgggaagcggggctgcaggatgagtaagagatacttacagaaagcaacaaaaggaaaactgctaataataatatttattgtaaccttgtgggggaaagttgtatccagtgcaaaccatcataaagctcaccatgttaaaacgggaacttgtgaggtggtggcactccacagatgctgtaataagaacaagatagaagaacggtcacaaacagtcaagtgctcctgcttccctgggcaggtggcaggcaccacgcgagctgctccatcatgtgtggatgcttcaatagtggaacagaaatggtggtgccatatgcagccatgtctagagggagaagaatgtaaagttcttccggatcggaaaggatggagctgttcctctgggaataaagtcaaaacaactagggtaacccattaacccaggagaaatcaagtgatcctcaaggctgatgacattgaacatgcgcatagaaacttaactcaactcctgaggtgatcttgaagatttttataccacttgaaagaggcgctcaatagtctatttccaagggatttcatggcctcttcttgaaatcaagactttttaaaagtcagacatgaacttgcatgtcatgaagatttcagcagatttgaactgtgttcaacttgtaaattgttaaaagaatttgaagtcactgtctgaggagctggtgaagagttgtttttttcagggtgatgttagagacagtcaccttttgagttattggctccagatgtgactacttttcttgtttctgcaagctgtatcccaagtgcactgtccttctgtcctggatgtgttcctgggtcctatgttcatttgctagtgggactacacatggctttaatgacatttcctttgagaacttttcctctggcatggtgtagactgagacaattttatttatatcctaatcttggagctcagaaagcctacatgttttaacatcttaaagttgcttttgttaaaggaatggaaatatatatccattggtaataatgttggcaagtaatagttatctgaataaatcaatcatataagaatgtatagacaagctgacatatttccctaaggctaacaacaccctgctgaagctctttgtcaaataggtagtagttagaactggattgccattttcattatataatactttgtacctctagagcactctccctttctgtttttttttaagtgagcttttctttaattttttatgtttacttattcccttcacagaaatcagcagtgagcagtcaagttaatgggtagccttcagtttcaaaaaaattgacagggatgcatgtgagtttctgatttcttagcttgaacattattcacttagatttcttccagtattttttaaaaaactgtcctatctcattttaaaagactttcttttgcttgatcccaatgactgtttgaatgcttatatatttgttcaatctgttgatagaaaaaattgttcattttcctcagtctcaaatttataaatatttgcttacagttttcctattcaaacaatttgttaggccaatattttgtgacatttttgtagcgattttaacgtttatggttttggttctacaggaaagtcataaatatttaaaggccttaaacatgtatgtactttttttttctaagttatagaatgtataattttgtactacatttattttgtttcatttgtgatatgaagggagagaagaaagaaaagtgcatagccattctgtaacaatattgtgtaaacctatagtttgaaggaatgcaaggagaaggatttctgtgttttactcattttaggctgttcagaagatgcttcaaaaattgtcctgttagaatttccatcatggaaggtggtatggaagaaggtatggaaatactttgtattctaaaaactcactgacgtggtcagttagacatacgttggtttccaggatagaggcccatatatcctggggagctttggtctattagtttgtgacaatattcaaaggccaaaacactactcagacactttcctgggaagagcaactaaaaatgtaaaattggttaaaaataaaatctgaaaagtatgtatctcacattgaactaaaatccactgtctcataagttcatggaatgaaatggctttctgcctccattttaatcatgcataaaatgaattagatggctttgagtggattttcacaatggctcaagactatatgaaattataaaaaaaaagttgccctggggtttctgcatcaattagaatatcattaatttctttgtaaccaagtgaaaaactatactttttggaaattatgaatttgtcctaggtttgtttgagatttgaaattatacatcatgcttctcattttttaaactatgttctttaaatcaacactggaaactctgtattatatacaagtgtaatacatgcatataatagaaaaaaaacatggaatttcaaatatactaactagattatccccagtagattaatgttgtgactattcagaaaaggtgaataaaattgggatataaaatggactctctttcataaa

SEQ ID NO: 2791 - DNA, 744 bp, Homo sapiens
aaggtaactctgggctacagagtccttgctgggggttcggggagcgcttggaccccggcttctgggacgcgtcaggtcgccgtgaagatgattgcatgagatcgtgcgtgtgaacgtttgttgacagctgttacttgagtccgacagccctgggggccgtgcatctgcgtaacatggctacctctgaactccttgggggacacgtatatctttgagaatccgatgaaaaccagagattccgcccttgttttcttagaattaaaaatattatccagcaatgcaaatgaacaaactataactacacacagctgcatggataaatgtcagaaacatgacgttgagtgtgagaagccagatgcaaacgaggactcactgtgcaattctgtgcatgtacagtggccaggagaagggagcactggctttgctttcatcaggccaaagatgcctttctttgggaatacgttcagtccgaagaagacacctcctcggaagtcggcatctctctccaacctgcattctttggatcgatcaacccgggaggtggagctgggcttggaatacggatccccgactatgaacctggcagggcaaagcctgaagtttgaaaatggccagtggatagcagagacaggggttagtggcggtgtggaccggagggaggttcagcgccttcgcaggcggaaccagcagttggaggaagagaacaatctcttgcggctgaaagtggacatcttattagacatg

SEQ ID NO: 2792 - DNA, 582 bp, Homo sapiens
agttacagtggtggggaccaggagtagggaggcagagactggccccgtgccaggcctagcactgcccacaggcagggcgaaggcgcgggagcagtttccagcagttgtacaggtagccaggtgtcggtctccagcctgagaactctggctgttgttccttgtgtcgtcccatattcctgcctggcctgcgatggacatcagcaagggcctcccaggcatgcagggaggcctccacatatggatctctgagaaccggaagatggtgccggtacccgagggggcttacgggaacttttttgaggaacactgctatgtcatcctccacgtcccccagagcccgaaggccacgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatctacaggaagggaggcctagcatctgacctcaagcatgtggagaccaactt

SEQ ID NO: 2793 - DNA, 223 bp, Homo sapiens
ggcctagatgggaggatcacgacatcaggagaccgagaccatcctggctaacacgtgaaaaatgccatggccttgtttctcatagcaggtaaagaagaaccaaagaattcactggtactaacaattaaacctatgccctctgagatctcattgggattccttaccccatcaccatgtgcacctcagaaactttccaagcgctggacaccttcgaagccagaca

SEQ ID NO: 2794 - DNA, 6520 bp, Homo sapiens
attgtttgaatttgaaaacggtaacatcgcagtgctgctcgcgggtctggctagtcaggcgaagtttgcagaatggaatctaattttaatcaagagggagtacctcgaccatcttatgtttttagtgctgacccaattgcaaggccttcagaaataaatttcgatggcattaagcttgatctgtctcatgaattttccttagttgctccaaatactgaggcaaacagtttcgaatctaaagattatctccaggtttgtcttcgaataagaccatttacacagtcagaaaaagaacttgagtctgagggctgtgtgcatattctggattcacagactgttgtgctgaaagagcctcaatgcatccttggtcggttaagtgaaaaaagctcagggcagatggcacagaaattcagtttttccaaggtttttggcccagcaactacacagaaggaattctttcagggttgcattatgcaaccagtaaaagacctcttgaaaggacagagtcgtctgatttttacttacgggctaaccaattcaggaaaaacatatacatttcaagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggttactgtgcataatgatagtgatgatactctttatggaagtttaactaactctttgaatatctcagagtttgaagaatccataaaagattatgaacaagccaacttgaatatggctaatagtataaaattttctgtgtgggtttctttctttgaaatttacaatgaatatatttatgacttatttgttcctgtatcatctaaattccaaaagagaaagatgctgcgcctttcccaagacgtaaagggctattcttttataaaagatctacaatggattcaagtatctgattccaaagaagcctatagacttttaaaactaggaataaagcaccagagtgttgccttcacaaaattgaataatgcttccagtagaagtcacagcatattcactgttaaaatattacagattgaagattctgaaatgtctcgtgtaattcgagtcagtgaattatctttatgtgatcttgctggttcagaacgaactatgaagacacagaatgaaggtgaaaggttaagagagactgggaatatcaacacttctttattgactctgggaaagtgtattaacgtcttgaagaatagtgaaaagtcaaagtttcaacagcatgtgcctttccgggaaagtaaactgactcactattttcaaagtttttttaatggtaaagggaaaatttgtatgattgtcaatatcagccaatgttatttagcctatgatgaaacactcaatgtattgaagttctccgccattgcacaaaaagtttgtgtcccagacactttaaattcctctcaagagaaattatttggacctgtcaaatcttctcaagatgtatcactagacagtaattcaaacagtaaaatattaaatgtaaaaagagccaccatttcatgggaaaatagtctagaagatttgatggaagacgaggatttggttgaggagctagaaaacgctgaagaaactcaaaatgtggaaactaaacttcttgatgaagatctagataaaacattagaggaaaataaggctttcattagccacgaggagaaaagaaaactgttggacttaatagaagacttgaaaaaaaaactgataaatgaaaaaaaggaaaaattaaccttggaatttaaaattcgagaagaagttacacaggagtttactcagtattgggctcaacgggaagctgactttaaggagactctgcttcaagaacgagagatattagaagaaaatgctgaacgtcgtttggctatcttcaaggatttggttggtaaatgtgacactcgagaagaagcagcgaaagacatttgtgccacaaaagttgaaactgaagaaacacataattatgtaggatttgaagatattattgattctcttcaagataatgttgctgatattaagaaacaggctgaaattgctcacttatatattgcatctcttcctgacccccaggaagctactgcttgtttagaactaaagtttaatcaaattaaagctgaattagctaaaaccaaaggagaattaatcaaaaccaaagaagagttaaaaaagagagaaaatgaatcagattcattgattcaagagcttgagacatctaataagaaaataattacacagaatcaaagaattaaagaattgataaatataattgatcaaaaagaagatactatcaacgaatttcagaacctaaagtctcatatggaaaacacatttaaatgcaatgacaaggctgatacatcttctttaataataaacaataaattgatttgtaatgaaacagttgaagtacctaaggacagcaaatctaaaatctgttcagaaagaaaaagagtaaatgaaaatgaacttcagcaagatgaaccaccagcaaagaaaggtactacttcagctgccagcagcaggcgtttaagaaagctaatttctaaaccagtaaatagaacaaggcaaacagaggggcattcacttgtgtctatccatgttagttcagctatcactgaagaccaaaagaaaagtgaagaagtgcgaccgaacattgcagaaattgaagacatcagagttttacaagaaaataatgaaggactgagagcatttttactcactattgagaatgaacttaaaaatgaaaaggaagaaaaagcagaattaaataaacagattgttcattttcagcaggaactttctctttctgaaaaaaagaatttaactttaagtaaagaggtccaacaaattcagtcaaattatgatattgcaattgctgaattacatgtgcagaaaagtaaaaatcaagaacaggaggaaaagatcatgaaattgtcaaatgagatagaaactgctacaagaagcattacaaataatgtttcacaaataaaattaatgcacacgaaaatagacgaactacgtactcttgattcagtttctcagatttcaaacatagatttgctcaatctcagggatctgtcaaatggttctgaggaggataatttgccaaatacacagttagaccttttaggtaatgattatttggtaagtaagcaagttaaagaatatcgaattcaagaacccaatagggaaaattctttccactctagtattgaagctatttgggaagaatgtaaagagattgtgaaggcctcttccaaaaaaagtcatcagattgaggaactggaacaacaaattgaaaaattgcaggcagaagtaaaaggctataaggatgaaaacaatagactaaaggagaaggagcataaaaaccaagatgacctactaaaagaaaaagaaactcttatacagcagctgaaagaagaattgcaagaaaaaaatgttactcttgatgttcaaatacagcatgtagttgaaggaaagagagcgctttcagaacttacacaaggtgttacttgctataaggcaaaaataaaggaacttgaaacaattttagagactcagaaagttgaatgtagtcattcagccaagttagaacaagacattttggaaaaggaatctatcatcttaaagctagaaagaaatttgaaggaatttcaagaacatcttcaggattctgtcaaaaacaccaaagatttaaatgtaaaggaactcaagctgaaagaagaaatcacacagttaacaaataatttgcaagatatgaaacatttacttcaattaaaagaagaagaagaagaaaccaacaggcaagaaacagaaaaattgaaagaggaactctctgcaagctctgctcgtacccagaatctgaaagcagatcttcagaggaaggaagaagattatgctgacctgaaagagaaactgactgatgccaaaaagcagattaagcaagtacagaaagaggtatctgtaatgcgtgatgaggataaattactgaggattaaaattaatgaactggagaaaaagaaaaaccagtgttctcaggaattagatatgaaacagcgaaccattcagcaactcaaggagcagttaaataatcagaaagtggaagaagctatacaacagtatgagagagcatgcaaagatctaaatgttaaagagaaaataattgaagacatgcgaatgacactagaagaacaggaacaaactcaggtagaacaggatcaagtgcttgaggctaaattagaggaagttgaaaggctggccacagaattggaaaaatggaaggaaaaatgcaatgatttggaaaccaaaaacaatcaaaggtcaaataaagaacatgagaacaacacagatgtgcttggaaagctcactaatcttcaagatgagttacaggagtctgaacagaaatataatgctgatagaaagaaatggttagaagaaaaaatgatgcttatcactcaagcgaaagaagcagagaatatacgaaataaagagatgaaaaaatatgctgaggacagggagcgtttttttaagcaacagaatgaaatggaaatactgacagcccagctgacagagaaagatagtgaccttcaaaagtggcgagaagaacgagatcaactggttgcagctttagaaatacagctaaaagcactgatatccagtaatgtacagaaagataatgaaattgaacaactaaaaaggatcatatcagagacttctaaaatagaaacacaaatcatggatatcaagcccaaacgtattagttcagcagatcctgacaaacttcaaactgaacctctatcgacaagttttgaaatttccagaaataaaatagaggatggatctgtagtccttgactcttgtgaagtgtcaacagaaaatgatcaaagcactcgatttccaaaacctgagttagagattcaatttacacctttacagccaaacaaaatggcagtgaaacaccctggttgtaccacaccagtgacagttaagattcccaaggctcggaagaggaagagtaatgaaatggaggaggacttggtgaaatgtgaaaataagaagaatgctacacccagaactaatttgaaatttcctatttcagatgatagaaattcttctgtcaaaaaggaacaaaaggttgccatacgtccatcatctaagaaaacatattctttacggagtcaggcatccataattggtgtaaacctggccactaagaaaaaagaaggaacactacagaaatttggagacttcttacaacattctccctcaattcttcaatcaaaagcaaagaagataattgaaacaatgagctcttcaaagctctcaaatgtagaagcaagtaaagaaaatgtgtctcaaccaaaacgagccaaacggaaattatacacaagtgaaatttcatctcctattgatatatcaggccaagtgattttaatggaccagaaaatgaaggagagtgatcaccagattatcaaacgacgacttcgaacaaaaacagccaaataaatcacttatggaaatgtttaatataaattttatagtcatagtcattggaacttgcatcctgtattgtaaatataaatgtatatattatgcattaaatcactctgcatatagattgctgttttatacatagtataattttaattcaataaatgagtcaaaatttgtatatttttataaggcttttttataatagcttctttcaaactgtatttccctattatctcagacattggatcagtgaagatcctaggaaagaggctgttattctcatttattttgctatacaggatgtaataggtcaggtatttggtttacttatatttaacaatgtcttatgaattttttttactttatctgttatacaactgattttacatatctgtttggattatagctaggatttggagaataagtgtgtacagatcacaaaacatgtatatacattatttagaaaagatctcaagtctttaattagaatgtctcacttattttgtaaacattttgtgggtacatagtacatgtatatatttacggggtatgtgagatgttttgacacaggcatgcaatgtgaaatacgtgtatcatggagaatgaggtatccatcccctcaagcatttttcctttgaattacagataatccaattacattctttagatcatttaaaaatatacaagtaagttattattgattatagtcactctattgtgctatcagatagtagatcattctttttatcttatttgtttttgtacccattaaccatccccacctccccctgcaaccgtcagtacccttaccagccactggtaaccattcttctactctgtatgcccatgaggtcaattgattttatttttagatcccataaataaatgagaacatgcagtctttgtc

SEQ ID NO: 2795 - DNA, 2398 bp, Homo sapiens
atgcgctgtcccaaatccgctgttactatgagaaatgaagagctgcttttaagtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatac

SEQ ID NO: 2796 - DNA, 1714 bp, Homo sapiens
agagccagagagaacttccagcgcaaaaggaaaataaaacttgtggctggtgtttgtgcaggagggtctccgccatcctgaagccccccgatcctggggcgtctcgggggccgccaaaggagcgccagggttaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccaggcttcccagcagcggcttatggaccagtggcagcagcggcggtggcggcagcaagaggatcagtcctgaatagctacagtgctcaaccgaattttggcgcgcccgcttccccggcaggctccaacccggcgcggcccggaggcttcccgggggccaacagcccaggacctgtcgccgatctctacggccctgccagccaggactccggagtggggaattacataagtgcggccagcccacagccgggctcgggcttcggccacggcatagctggacctttgattgcaacggcctttacaaatggataccattgagcaggtgctttcgttgccatctcactctgagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttattttttcttaaaacatttttttttgcttgttttggttctgttctcacttttaaaggatgctgagatggtaatatgactctccatattttggtaccaattctgagactgtatgaattttcaggtggaactttagcacacactgaagcaaagttgtgaagtgcagggcgggaggtgggcgtgagct

SEQ ID NO: 2797 - DNA, 430 bp, Homo sapiens
ccacaagccatgctatggggctctctttggacccaggggggtgaacattggtggtgtaggctcctacttgtacaatccccccactcccagccctggctgcaccactcctctcagccccagcagcttcagccctcccaggccaaggactggcctcccccaaggcaagaaaactgagaaggtgatgtcattaggcagaaattggcaccgaccgtgtctgaggtgccagcgttgccacaagaccctgactgctgggagtcatgctgagcatgatggagtcccctactgccacgtcccctgctacggctacctgtttggccccaaagccctctaggtcctgcctgtttcttgcctgcctcacccagtggcatcacgatgatggtaaaaccagccagggctgagccagtaagggtgcgggtgatggcaaacatta

SEQ ID NO: 2798 - DNA, 714 bp, Homo sapiens
caacagggaccgaccaaatcgtcatgcagctgtttggatgctttaaaaaaataaatccccacactcattacgcgttttatgctgctgacttttttatttttaagacatctgctcccgaaagctcagagccctttagcatttcattttctaaacgaatcctaatctttcctgtgactgaatcggttcagaggatatcttttcaataaggaaggaagccctcccctgctcactggggacgtcgcagggtttttaaacctaaagatttactcttttgtgcacagacgctggaagcatttggaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgcc

SEQ ID NO: 2799 - DNA, 1911 bp, Homo sapiens
agtgctccgggcgcttcaggctggcttgggtcctgctgctccaaccccaagggccctggagcgctccctgatacctccatcactcaccatggccagccagttctgcctccctgaatccccatgtctctcgcccccgcccttatcccccttggctctggcgccctcttcggccatcagggaccagcgtaccgccacgaaatgggttgcgatgatcccccagaaaaaccaaacagcctcaggggacagcctggatgtgagggtccccagcaaaccttgtctgatgaagcagaaaaagtctccctgcctctgggaaatccagaaactgcaggagcagcgggaaaagcgcaggcggctgcagcaggagatccgagctagacgcgccctcgatgtcaataccagaaaccccaactacgaaatcatgcacatgatcgaagagtatcgcaggcacctggacagcagcaagatctcagtcctggagcccccgcaagaacatcgcatctgcgtctgcgtgaggaagcggcctctcaaccagcgagagacaaccttaaaggaccatgccttcgatgacaaagcctccaacgagttggtgtaccagttcaccgcccagccactggtggagtccatcttccgcaagggcatggccacctgctttgcctatgggcagacgggaagtgggaagacgtacaccatgggtggagacttttcaggaacggcccaagattgttctaagggcatttatgctctggtggcacaggatgtctttctcctgctcagaaactccacatatgagaagctggacctcaaagtctatgggacattttttgagatttatgggggcaaggtgtatgatttgttgaactggaagaagaagctgcaagtccttgaggatggcaatcagcaaatccaagtggtcgggctgcaggagaaagaggtgtgttgtgtggaggaagtgctgaacctggtggaaatagggaatagctgtcggacttccaggcaaacacctgtcaacgctcactcatccaggagccatgcagtgttccagatcatcctgaagtcaggacggataatgcatggcaagttttccctcgttgatttagctgggaatgaaagaggagcagatacaaccaaggccagccggaaaaggcagctggaaggggcagagattaacaagagtcttctagccctcaaagaatgtattctggctttgggtcagaacaagcctcacaccccattcagagccagcaaactcacactggtgctccgggactcctttataggccagaactcctccacttgcatgattgctaccatctctccggggatgacctcttgtgaaaacactctcaacactttaagatatgcaaacagagtaaaaaaattaaatgtagatgtaaggccctaccatcgtggccactatccgattggacatgaggcaccaaggatgttaaaaagtcacatcggaaattcagaaatgtcccttcagagggatgaatttattaaaataccttatgtacagagtgaggagcagaaagagattgaagaggttgaaacattacccactctgttagggaaggataccacaatttcagggaagggatctagccaatggctggaaaacatccaggagagagctggtggagtacaccatgatattgatttttgcattgcccggtctttgtccattttggagcagaaaattgatgctctgaccgagatccaaaagaaactgaaattattactagctgacctccacgtgaagagcaaggtagagtgaagccaatggcgagagatcaggtccgaaatgctgcattgctgcagtttccaccactcttatacaggaaaactgtccaaattatctaaagatcctcctgagaagcttaaaacatcttaaaatacactgatgggaaacat

SEQ ID NO: 2800 - DNA, 394 bp, Homo sapiens
tgtcagcttgcattgggaactgctctacagccttagaagagctgacagatgacatgacagaagacttcctacctgtgctcagggaatatattttatactctgactccatgaagagtgtattgaagaagagggaccaagttcaagcagagtatgaagccaaactggaagctgtggctctgcggaaggaagaccgccccaaggtaccggcggacgtcgagaaatgtcaggatcggatggagtgtttcaatgctgacctgaaagctgacatggagaggtggcagaacaacaagaggcaggacttccggcagctactcatggggatggctgacaagaacatccagtattatgagaagtccattgcagatctgaagtgatggcctagggagagagcagg

SEQ ID NO: 2801 - DNA, 1124 bp, Homo sapiens; identical to SEQ ID NO: 2733

SEQ ID NO: 2802 - DNA, 1415 bp, Homo sapiens
gggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccc

SEQ ID NO: 2803 - DNA, 3009 bp, Homo sapiens
agtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtgtggatggccagggtacctggggactcaggctgctgccagttctgctcaccaccatccgtgcttggcacagaagtagctgcatagaaagagcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatgtagagaaaaaaaaaacctgctctatatctgaaagagctcttgggaagacagagaaacataaagaggaaattatagcacagtgtggtgggtgttacgggaagtccaaccccagcattatgggagttcaggggaaggggcatagcccagcctggaaggagaggatgagtgggggatggctttctgaaaagggtagtctaaaggatgcctatagtcaatagggaaaagaggggaagaagcatcttaagaagaggaaacagcagagaactggctggatgacctgtgactctggagcactgggttgtctccattgtccttatgggcagatgtgtgccatccccagccgacaccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgacctttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagatgtaaaatacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattaaagattgaattgctttccctgggagtgtgcagtatctcattaaaatgttgtatattcaaaaaaatacagacacacacaagtgcctatataatgataaaacatatgcaaagcacccaaacctgtgattccagaaaggtagatcctatttttctgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 2804 - DNA, 1254 bp, Homo sapiens
agaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctatt

SEQ ID NO: 2805 - DNA, 1966 bp, Homo sapiens
agaagtgcggacgcccggctcccggcgtggacgccatggtgctgtgcccggtgattgggaagctgctgcacaagcgcgtggtgctggccagcgcctccccacgccgtcaggagatcctcagcaacgcgggtctcaggtttgaggtggtcccctccaagtttaaagagaagctggacaaagcctccttcgctactccgtatgggtacgccatggagaccgccaagcagaaggccctggaggtggccaaccggctgtaccagaaagacctgcgggcccccgacgtggtcattggagcggacacgatcgtggttgagtgggagagaacacagcgtgttcacaggtgtcgcgatcgtccactgctccagcaaagaccatcagctggacaccagggtctcggaattctacgaggaaacgaaggtgaagttctcggagctgtccgaggagctgctctgggaatacgtccacagcggggagcccatggacaaagctggcggctacgggatccaggccctgggcggcatgctggtggagtccgtacacggggactttctgaacgtggtgggattcccgctgaaccacttctgcaagcagctggtgaagctctactacccgccccgtccggaggacctgcggcggagtgtcaagcacgactccatcccggccgcggacaccttcgaagacctcagtgacgtggaggggggcggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggttacagtaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaagatctgttccaggatgcgtactaccagagcccggagacgcggctgaggttcatgcgggccatgcacggcatgacgaagctgactgcgtgccaggtggccacggccttcaatctgtcccgcttctcctccgcctgcgacgtgggaggctgcacgggtgcactggcccgagagctggcccgtgagtaccctcgtatgcaggtgactgtgtttgacctcccagacattatcgagctggccgcccacttccaaccccccggaccgcaggcagtgcagatccacttcgcagcaggtgactttttcagggaccccctccccagcgctgagctgtacgtcctgtgccggatcctgcatgactggccagacgacaaagtccacaagttactcagcagggtcgccgagagctgcaagccaggggccggcctgctgctggtggagacgctcctggatgaggagaagagggtggcgcagcgcgccctgatgcagtcactgaacatgctggtgcagactgaaggcaaggagcggagcctgggcgagtatcagtgcttgctggagctgcacggcttccaccaggtgcaggtggtgcacttggggggtgtcctggatgccatcttggccaccaaagtggccccctgaagcccaggcagcatgttcattatagggatgtcctcccccaggctgcaggtggaccgcccggtccccaagtaccataggacagtcacataggagcgtgtagtcgtgactgaataaagaaagcaaaagcctg

SEQ ID NO: 2806 - DNA, 685 bp, Homo sapiens
gtgacaggaaatggagctggggagacaaaaatgtggataacaacaaaagaatttcaacaggtaaaaaaatgagtcaaacatctctcaaacagaaaaagaatgagcctggaatgaggtcctcaaaagagagtctagaagcagaaaaaagaaaggaatctgacaaaacaggagttcgtctgagcaatcagatgaggcgtgcagtcaatccgaatcactcgctgagatgttgccccttccagggtcactcgtcgtgtagacgctgcctttgtgcagctgagggaacagcccttggcccctgccacacaatacgtatttatattcacatgtgcctgttgtgggagcagggccagcagatcaccatgatgagggtgagcagagatcacactaccgattctggaggggaaccacagacaacctggggatcacaagaatcatcactgcggaagacagactctcgagggtaccttgtgcgcagtcaatggtctagaatatcccggagcccatccaccaaggctccatccatagatgagcctagaagcaggaacaccagtgctaagctccccagcagctccacgagctcccggactccatccacctccccaagcctgcatgactcctcaccgccgccgctgtccgggcagccctcgctccagccacccgcgtcgccccagctgccccggtcgct

SEQ ID NO: 2807 - DNA, 3116 bp, Homo sapiens
attcactgattagatccagcgctgagaggcagcactgctccttctctcacgccaactgagtctcttgatctgtacatgcaatcccaggcagctcgcgaacacaaacccggggccagccgcctactgctgctgctgctgctgccgctgccgccgccgccgccgccgctgcctccgccggctctgcgaacccgggacttttcatgcaccacactctccgcctgcttccctccgtgtcctgaaaagtgcgaccgttctcccaaggaatttccacggtcttaggagggaatgattccccagtaatattccctgccctgacccaaagtgctggttggcctccctcccagggaagactgcttcttgcgtaacgccggccacagaaagagactccgatggacttacaccgggcagccttcaagatggagaactcatcctaccttcccaaccctctggcatccccagcactgatggtcctggcatccacggctgaggccagccgtgatgcttccatcccttgtcagcagccacgaccctttggtgtacctgtctcagttgacaaggacgtgcatattcctttcaccaacggttcctatacctttgcctctatgtaccatcggcaaggtggggtgccaggcacttttgccaatcgtgatttccccccttctctactacacctccaccctcaatttgctcccccaaatctagattgcaccccaatcagtatgctgaatcatagtggtgtgggggctttccggccctttgcctccaccgaggaccgggagagctatcagtcagcctttacgccggccaagcgacttaagaactgccatgacacagagtctccccacttgcgcttctcagatgcagatggcaaggaatatgactttgggacacagctgccatctagctcccccggttcactaaaggttgatgacactgggaagaagatttttgctgtctctggcctcatttctgatcgggaagcctcatctagcccagaggatcggaatgacagatgtaagtacagagcagcggcattgttcgacagccaggccccaatttgccccatctgccaggtcctgctgaggcccagtgagctgcaggagcatatggagcaggaactggagcagctagcccaactgccctcgagcaagaattcccttctgaaggatgccatggctccaggcaccccaaagtccctcctgttgtctgcttccatcaagagggaaggagagtctccaacggcatcaccccactcatctgccaccgatgacctccaccattcagacagataccagacctttctgcgagtacgagccaaccggcagacccgactgaatgctcggattgggaaaatgaaacggaggaagcaagatgaagggcaggtatgtcccctgtgcaaccgccccctggcaggatcggagcaggagatgagtaggcatgtggagcattgcctttctaagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 2808 - DNA, 650 bp, Homo sapiens
gttctccgctgaggaggagcggggcagaggagggaggcagcgggtgagagttcagagttcagcagcagcagcccgagcccatgattcccatatgccctgtagtttctttcacctatgtgcccagccggctgggggaagatgccaaaatggcgaccggcaactactttggattcacccacagcggggcggcggcggcggcggctgcggcccaatatagccagcagccagcttcgggtgtagcctattctcatccaactacagttgctagctacactgtccatcaggctccagtagctgctcacacagttactgctgcctatgcaccagcagccgccacagttgcagttgccaggcctgctccagtagctgttgcagctgctgcaacagctgctgcttatggaggctaccccactgcacacacagcaactgactatggttatactcagaggcaacaagaagcaccaccaccaccacccccagctactacacaaaactaccaggattcatactcatatgtaaggtccacagctcctgctgtagcttatgatagtaagcaatactaccaacaaccagcagcaacagaagcaggcagcagcagcagctgctgctgctgctgcaacagctgcctggacagggaccacctttactaa

SEQ ID NO: 2809 - DNA, 991 bp, Homo sapiens
ggccgttacgcgattttcgctcccgcgggcagcgcctctcaggccactcccgagggaccccgaggacgcactcgggccccagggcgacggttcaaacgggccattgtgcgcccccggggtcccccggcccctgcagggctacttgggcgcagagccgcggagggtctccgttcctagaggtcctcctatcccgggctgcctgagtcctcgccagcatccgccctctcccactcccatccttcctggatccgcctctcggttcccgagggacagtcccgaccgcaaacccacgtagagtaaggaatgtgggacaggcgacagaagtggcatacggtcctgcgttatccctccgtctcgccacaccttgtgtctccatctctccccacttccttccctccgtctgtcatctgtcatccccggtcgctctaagaccaggattccaattcgcctagtgaggaatctcactaggggaatttatcgcgacatcataaattaacgggttcattttgactgaaaaagcgaaggacttttttcaggcagaaaacaagtctcgtctggacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccag

SEQ ID NO: 2810 - DNA, 567 bp, Homo sapiens
aggctaggcgtggacccaactggcgaggctgctggggttgcagcgggacagttggggcggccccgcaggcccaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaacagataccgagatattcttccatttcaacatcatggatatagtggcccaaatgagagaacaa

SEQ ID NO: 2811 - DNA, 4649 bp, Homo sapiens
gaggatgagtatatccagagtcataacttcgattctgcaatgaaagtcaccagccaagggcagccctccccagtggagccccgaggacccttttatttctgcaggttattgcttgatgacttgggaatgaattcttgggacagaaggaagaattttcatctattgaagaaaaattcaaaattattgagagagctgaaaaatttggactcccgccagtgccgtgagacacacaaaatcgcagtgttttacattgctgaaggtcaagaagacaagtgttcaatcctctctaatgaaagaggaagccaagcatatgaagactttgttgctggacttggatgggaggtggatctctccacccactgtgggttcatgggtggccttcagcgcaatggcagcaccgggcagacggccccttactatgctacctcaactgtggaagtgattttccatgtttccactcgaatgccgtcagactcagatgattccctcaccaaaaagcttcgtcacttggggaatgacgaggtccatatcgtctggtctgaacactccagagactaccgcaggggtattatcccaactgcctttggagatgtttcaatcattatttacccaatgaagaatcacatgttcttcatcgcgataacgaagaaacctgaggttccattttttgggcctctgtttgatggagccatagtgagtgggaagctgctgccaagccttgtatgtgccacgtgcatcaacgccagcagggctgtgaagtgcctcatcccactctaccagagcttctatgaagagcgagctctgtatctcgaagcaataattcagaaccaccgcgaagtaatgacattcgaggatttcgcagcccaagtcttttctccctctcccagctactccctcagcggaacggattaaaacacgtaaaggtctcatttcaatatttgagcaaggggccctggcctccagtctgagtgctgacctcgaagagcccctgagtgaggaggagacagaacaccctctcctgcctctgccccgagccactaaacccagaatctccaggaaatttcgttgctgtactagtgccctcagcaggtcttcccattagtggacttctgaagcccatggtgaatcccactaccgtgtctcagatgggactcaaactaggctgtatcatcttgtcctgaaacctcacaaaccttggacttccaaagaagaaaagaaaaagtcaccaaaaaccagagatgaacccactgacacgtgggcactggtgtggctgctctgggcagatgacagcaggaaaagattctgcgctttcagggagggggcagagggcagcttgcttctgcaccccaagttgtttcttctcatttatgaacccaagcatgattcacaaaggggctggcaaaacaattgtctaattgaggaatctgatctgcattgattttgctagttccttttatgttaggatttatggtttactcaaaaatttcatcatcatggaaattggctttccccggggtcttttgcccaggagaagttttacctcagttgtccagtgttttcccacatggtacctgacgcccgctaactaagcagaggctctcctcaccacgcagaggcgcttcaggtcatgacagtgatgcccctatcttagaacactcagaagattccagaaatacagggtcctgtccttgcataagttcctgcaggacaggaagtgtcccaaggctcaaaacaacacagaccacatccacacaaaaggcgcatgccggcttcaggcgctaggctgagacgggtaccccccgaatggccttgtgcctccaaaagcctcacgctgcaactttgctgctcctgtctgttgcccagagaggcctcacacaggcctcagaaatgtttcttgtcacacaaagcttttggtagccgattccaagcgagggatttaatccttacatttttgcccatttggctccaaggaaggcttattagacctgtttttttgttgttgttgtttttttttcttaaaaacaaaatgaatgaatgaatgaaaagagaagcaatggtgagccctctcctgctggggcgccctgggtgggccttgcccgtcctgcagcagagaaatcagtcagcagcgaagagctgctggcgcaggccccaggctgtgtcctggacccttgacctgcctcagagctagaggtttgctccaccccgcacttcacttgggaagtaaatccaagaagcttaccagagtccatcgccactgcgcaggctttgttctcacagcggccaggtacagagcaacgccctgcagtgggaagggacagcagcacgagagacgcagcccctaactcagggcttatgatgggtgggctggtcctgggaaaggcgggccctgtgcgggaggcctccccaccttcctgtgccctctgccctctgcccttgcacacacttgttaccttcaggctgcttggccacccaggcctgaagaagccttctgaggctctcaccccatcagaacggccattttcactgaggagccagttttttccatttgccatggagctggtttggctggaacctggcctttgtagggaaaacggggagactcaggagccagactcactcttgggacaaatgagaaagagctgagccagtcgttcctgtcggaagggcgggcctgctcatcctggcgagaatttgcttttctgctttataggggattgcaggccaggcccactgacaggagcaccttgagaaccacctgaacagaagagaatgagggtgccccaaagtggaaggaagcttctggcccctgggccgttttgggaagggcccaggatactcacgggggctgaagggcaatgtgaagagtgactgcaagtcctggcattttctgtggtgtcagcaaatgcccctttattttaaatgattccagacatctgggcagcatagcttggccaccatcactcaggcttgatcctgctgttgagctgctcctgtctcctgtttacctcactcctgttgggaaggccatcgcatgctcctaggctccagagtcccctgtaggtctctaccagcaggtcgcctctgggagaacgtttcatcttcaggctctagaaactcctgttgcggaattgctggctttagtagaaaagatatgtcaggatttagaaatcgtattgaactctcctggacttctgctccatgatttcattttgctttcacgaaccagcgatccctaccttggggtgggaaattcaattgtaggcagcaaataactcaaccctcctgtaacccctgaggattataacgaccccatgacccccgatgacagccagcagtttggtgactagagttttttgagcctgccattctcagtagcagctttggtctggagatggaacgtggagcagggaatctgacagccacgtttctcgtgatcacgtggactggagttgtttttgttatctggggtggaaaattgcaatgatcaagtttcttttttattttttttttacttagaaaagcaaatattgtgtttttgtaataaatccctttcagcaaaattgcggaggatcattcatccactagggccccacctgaggcacagcgctgactcatcacggtggtaccagtaggtcagccatctggaaacagaagtggccctaattgggccaaaatgtggtaagactcgctggcctcaggcagggccaggccagttccctcacttctctgcacacctattcccagattccatccagagcaaagctgatgtttatcgtctcattgtacttaggctttcgtactttaaaaaattatgactttttaaaaataagccttcagcagacagaagtgaagaaatttagcctgggttgcctcagcaacaaagtctgcggttcctaagagccacatgttggggaagtggggtgacccaaacttggtgacataggttgattgatcagaccctcagccttacaagcaagagctcatgcagatccacagagccatgcacatcctgtcttcctgaccttcctcaggtggcaccacctgcgccccatggacctgctgtatcggtgtcatgtggaggtctgatgaatcctttaaaacctaactgtgatgtcgtaaatgtaactgtgctacctttatatctactgaagggcagcgtctgcatccgagggaaattcaacatgaaacaaccatcgttttagttgcactcagtctgtccatatgacatacacatgaagtgaatgtttccttatgttttcaggtctacaatgtttagtacatgtaaataaggaaaaaatttgataaatatggtaaattaagttatagcgtgtcatttgattcttattttgctgtctcttgttatttaattttcctaatgctccacatctaggttccttcctaggtggtgggaacaccttgcagacgtgtgtgcaccaggacacaccgcggcccaggcagccacaccgagaaagcacacatctccactgatggcagccacccgactctccagttaacctcttttactctttaattctgatttactgtgatgatttaataaagtggaaacacagcacttcagtgctatatgtttctctcattctcattatagtttataagaaaataaagttcaccctggcatctaataaaaa

SEQ ID NO: 2812 - DNA, 3535 bp, Homo sapiens
tagggcacgggaagggctcgctagaatgagctcttaaactggttgggtgtaagcggttttgggctagtctaaaccaaacaactgagaataaacgcggggttcctgcaggttgagagagtacctgtctgcaaatgtccagtagtgatggattgccttgtaggccccagagcaatcggggaagttagcattcttgttcaagaagctgctggttcacttagagctataaaagaatgttgtgagtttggattttcttccaaacgttcaggattgaggttagggctggtggtgagggatcatgtaaagaggtttgagtggctcagccttaggtcccggtgtggaaagcttattcttttggtgtcatcacgtggccgtgggaattatttagaatgtgatctgccctcatgagaagaaaggagctctgaagccgttgcagttcttcctccctatgtggaaaatcgaatttctggaaacatcctccgtattgggagattttgcctatgtaaaggctatccttattggctagcggcactaattactttaaaagtaggatggaagtacaagtatctcaagcatcattgggtttcgagctcacttctgtggaaaagagtttaagggagtggtctagactttccagggaagttattgcctggctgtgtccctctagtcctaattttatacttaactttcccccacctccttcagcctcatctgtttcaatggtgcaactcttttcatccccttttggttaccagtcaccttcaggccattcagaggaggaaagagaggggaatatgaagtcagccaagccccaagtgaaccacagtcagcatggggaaagccagcgggccttgagccccctgcagtctactctgagttctgctgcatctccttcccaagcgtatgagacctatattgaaaatggactcatatgccttaaacacaaaattagaaacatcgagaaaaagaagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgagtgttgaagaccagatggagcagtcatccttgtacttttgggaccttttggaaggtagtgagaaagcagtggtaggaacgacatacaaacacttgaaggatctactgtctaaattgctgaactcaggctattttgaaagtatcccagttcccaaaaatgccaaggaaaaggaagtaccactggaggaagaaatgctaatacaatcagagaaaaaaacacaattatcgaagactgaatctgtcaaagagtcagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgcctaagcctgtgcatcagcctgtaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggctacttcttctccagttacttgtagctcaaatgcttgcttggttactaccgatcaggcttcttctggatctgaaacagagtttatgacctcagagactcctgaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactgcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagctaactgcttcattatgagaaactcactgttgctaataaaacagcagggtggagtgattcttctcaggtgagcagcccagaaagagacaacgaaacctttaacagtggtgactctggacaaggagactcccgtagcatgacccctgtggatgtgccagtgacaaatccagcagcc

SEQ ID NO: 2813 - DNA, 2724 bp, Homo sapiens
aataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccag

SEQ ID NO: 2814 - DNA, 535 bp, Homo sapiens
cggagggaggcgggactcaagagtagccttcctcgaggacctgcctttcccatttgctgcctgaagttaatgtttcttgctggccaaatcagggacatgccggcattccccacccacagccagggggcttgggttctgagctgatggggtacccccctctgcagagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaag

SEQ ID NO: 2815 - DNA, 1289 bp, Homo sapiens
acgccagccttgatgatctgaccatggaggctgagtccttcccatgcctcctacggccattttttaaagaaagatcttgtgctttgcgcccagccttccatacagcaaagtgcgagaaactacaaaaggagaaggaggagctggagaggcggttcgaggcggaaatggcgcgcctgcaggaggagcacggtgaccagctgctgagcatccggtgtcaacaccaggagcaggtggaagatctcaccgccagccatgatgctgctctcctagagatggaaaataaccacacagttgccatcacaatcctgcaggatgaccacgaccacaaagtccaagaattgatgtccactcatgagcttgaaaagaaagaattggaagaaaattttgaaaaactgcggctgtcattgcaggaccaggtggacacgctgaccttccagagccagtctctgcgggacagagcccgccgcttcgaagaggccttgaggaagaacacagaggagcagctggagattgcattggctccttatcagcacttggaagaagacatgaagagtctgaagcaggtattagaaatgaagaatcagcaaatacacgagcaagaaaagaagattcttgagctggaaaagctggcagaaaagaacattatcctagaagaaaagatccaggttctccaacagcagaacgaagacctcaaagcaaggattgaccaaaacacagttgtcaccagacagctgtcggaggaaaatgctaacctccaggaatatgttgagaaggaaacccaggagaagaagagattgagccgaaccaatgaagagctgctttggaagctccaaactggggacccgaccagtccgattaaactctcgcccacatctcccgtttaccgcggctcctcctcggggccctcctctccggccagagtcagcacaacacccagatgacgccactacacggcctgcgggagctccggcttctcgtcctccggtctccaccctgagggagcaccgacccggtgccgccggagctggccctgtgcgcatgctcagtagctgcgaatgcatcctaggcgcgtcctcctctgatccccgtgtaagactgccctggtgtcggcacttaggaatgtgtaaatggtaaagtctgatgtgcaaacgttttaccatagttagagccaaaagaaagacacttgcaattgttcttgagcaatgaactttcactgcagaatttcaggttagttacaaaaagctcagttttcaatatacattgaataatcattgtgtactgcaccgata

SEQ ID NO: 2816 - DNA, 2749 bp, Homo sapiens
acgctcacttccgccgccgtcgggggctgcgcgggggctgtggctccgggactgcggttaaaattgcagagttttctcgtactccagaagactttctaaagaaatatgatgaactgaaatctaaaaatacaaggaaccttgacccgctggtgtacctgttgtcaaagctcacggaagacaaagagactctgcagtacttacaacagaatgcaaaagaaagagctgagcttgcagccgctgctgtgggcagcagtaccaccagcatcaacgtccctgccgcggcctccaagatctccatgcaggagcttgaggaactgaggaagcagcttggcagcgtggccacaggctccacgctgcagcagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgataggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaagccctcactcgctaccagatgctcttcaggcacatgttctactgcaagcacgtggagcggcagctctgcagcgtctggatcagcaacaaaaccgccaagcagcactcgctgcactccgcccagtggtttgctggggctttcactctgcggcagcgaatgctcaacttcgtccagaatattcaatactacatgatgtttgaagtgatggaaccgacctggcacatcctggagaaaaacctgaaatccgcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcctggggctgcccgcaggggccgaggagcgggcccggaaggagctcgccaggaagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgattgactcagctc

SEQ ID NO: 2817 - DNA, 1468 bp, Homo sapiens
gggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagctcccagggtgccatatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccc

SEQ ID NO: 2818 - DNA, 2340 bp, Homo sapiens
aaaaggcctcagcctgatgcccacaggcagagcacacaggcagccgagtggccgcagccctgcagtggaggagtgcctcgtgcacctggtggttttctgcaccccaacaggtgtgtctggccactgctcctctcactgcagcccccgctgctccacaccatgcccttctggcccatcaggtgtctgaagaggagcaggcgtatgcccaggggtggtgccggggagcgggagaaggtgccggccaaccccgaggcgctcctgctcatggccagctcccagcgtgacatggaggactgggtgcaggccatccgccgagtcatctgggccccgctgggcggagggatctttgggcagcgcctagaggaaacagtccaccacgagcggaagtatggcccccgcctggcgcccctgctggtggagcagtgtgtggacttcatccgggagcgcgggctcactgaggaggggctgttccgcatgccaggccaggccaacctggtgagggacctgcaggattccttcgactgtggggagaagccactgtttgacagcacaacagacgtgcacacggtggcctccctgctgaagctgtacctgcgggagctccccgagcccgtggtccccttcgccaggtacgaggacttcctcagctgcgcccagctgctcaccaaggacgagggggagggcactctggagttggctaaacaagtgagcaaccttcctcaggcaaattacaacctgctcagatacatctgcaagtttctggatgaagttcaggcatactcaaatgtcaacaagatgagtgtccagaatctggcaaccgtttttggacctaacattctgcggccacaggtagaggacccagtaaccatcatggaaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggaccaggaaaagaaaaaatacatcatgctggaaataaagctgcggaactctgaacgggcgcgggaggatgcggagaggaggaaccagctgttgcagagggaaatggaggagtttttttcgaccctaggaagcttgactgttggggcaaaaggtgccagggccccaaagtaaaaggaatggcagagctcacttctgtaccacgtctgctggtctccagccttgtatggagttagaagcgtctgtatctctggagcagccaggcgctctggagccagctggagagagagagatcctgatacctctgtggggactgtggggacttttgggaccccacacactccaggtgggatcagatgctgctccaaccatgcagttcctggtgagggtcagaaggggacggtaccaagagtagcgcttagcccttacccaggaaatatccttcatggccacagaaatggagggcgcccaggatccaggcagccaccgggaacagtcagctttctttattaaatgtgctcacaaagc

SEQ ID NO: 2819 - DNA, 1943 bp, Homo sapiens
gaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgtaagtaagaagttaacagagcaaaaaataaccagcaaggtaaatattatttgtactaatagtaagtatttatacataggaagctataactgtttttattattcattttaagatttaattgttgctgtttgggaaaagtgtagccataatatcagacagcttattgttcccctaaattggttcctgtctcagtttatcaatttgtcctacagcaactatttatgttcatttaaattgccttttaaaatattcatgtcagtttttttttgttttgttttgttttaattctgaagtcaacttgctatattgtgttttttaaatcatttagtcaatcaattcttgtatctggggaattaagagtaagttacctaggaaaacattgactttagggtagattctcaaaatcgccaagaatgaagaaatgtagcacagtcccttaaaatatgaagggtgctgtttctttactgcctagccatagagaacaagctgttacgttgttcacaaacactcacgttagcatctgagatataccagattttaaagtagtagagaatatatcctggtaatgtgaagggtgcgcctggatcacatagtgcgtgacatgtgagagcactaaatgtgtgtgctctcctttattttaaaataattgaaccaatgattctgattttttcctgcttcccccataacaatttggaagcaactttttacgtaagaatgagtaagaaggacctgctctcaggtccttcttaagggaggaggggaataaagatcccctaaggaaaaaaaaaaaatctgtttagaattccagcctgtggtatttttacgaaataggaaaatagactgtcttactttttgaaaagatcctatttaatgtattgtgatgtcaaaaggaaatggaatgccatgtaactgctatgtttaagtttttatttttatagtgcaggataggtgcaaaaaagcaccagtttgaactgttgtgtcatgtttttcttttataaaatattaacatcggcctcagcaacatagcaagaccctcctttagtacaaaattaatttttaaaacttagatatggtggcatgcacccatagtcccagatactcaggaggatgagaaggaagagtctcttaagaccaggagtttgactctgcagtgagctatgattgctccactgcactccagtctgggtgacgaagccagaccccatctc

SEQ ID NO: 2820 - DNA, 4251 bp, Homo sapiens
gtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttct

SEQ ID NO: 2821 - DNA, 1805 bp, Homo sapiens
gtcattatccatcgagtccttgagaaacaggaagttgaagtgttctacccagactttggaaatattggaattgttcagaagtcctccctgaggttcctcaagtgctgctacacaaagcttccagctcaggctatcccttgttctttggcttgggtgagaccagtagaggaacactggacatcgaaagctattttgcagttccagaagttgtgcggtttgaagccattagtgggggtagtggatgaatatgtagatggaatccttaacatttttttgtgtgacacatcctcaaacgaagatgtctatttccatcatgtcttgagaacagagggccatgctattgtatgccgagaaaatatctcttctaagggtttcagtgagctcaaccctttagctttatacacgacatccagtggagggccagaggacattgtcttgacagaactgggttatccttcccagcagcactattttaatgaagaccgaaagataagtccacagtcaaaagagagtgagttacgtatcttgcaagatattaatgatgaaaagtctttaagtcatcttaaatctgagtcaaaggagccattaaaggattctgaatttgagtctttgaaaacctgtaataagagctttgaagaagatccaaagtggtccaacccagaaccaaacgatctgaaggaagaaaatgaggatgagatccccactggaatgccatgcctggagtcagtgaccataggtgatgatatttgggatgagaactggttacctctacaggctaagatgggaaaaggaggtgatgctgcctcccatctatttactgcaagccttggtggaaagaatcagtattcatcatgtaaagaaatgccacagaaggactggtgtttttctacccctaaagatacatgggatgattcttggcagccttcaggccttgtaaatggaacgaaagtagaagttcataagccagaagtactgggtgctcaggaaaaaaatactggcacaaacaggactcaaaagcaactagacataaatggttcttcagattcttccacactgcccaaattggaagaattctgtacctctcttacccagtcagagcagtcagcagacgggagccagtctgaacccaacaacagtcagactcagccaaagcaaattcagctttccacagcagcaccctgttcaacaactgcagtggatgattccgcagaaaagccctctggttctgtggaaagctcaccagagatcctaaagaatgaagatttttctagcagccgtgctattacattgtacaaagacaagcgtcaagaatctgtagaccagctgtctttgattttgtcttatgagtgccagatttctcagaagctctacattcctcgaagtacagccactgctgccttaggtgctgccgcacggttagctacatccaggagcctcctacactggtaccccagtgtgaaaaggatggaagcatgagggagggagggaggagggagaaaaacagaatccagccgcttaggctttgatgaactcccaggccaaaatgaggagttattgaagcaaaatagtatcttgatcattgatacttttgtctttctgtgactatatgttagctttattatgctaacagtctactttgatgtgtaagtaagtattgatatttactgttaatcttgatttttcttgattttattctgtgtcattttgttcacctttgtttttaatgtagtttaaaggaatttgtttttttgtgtttgtttttcttgtacattatcatgactgataaatgaaaattgaaaaactaa

SEQ ID NO: 2822 - DNA, 560 bp, Homo sapiens
agcaccggacttggagtcagagagacctggctgcgaatcccggctccgccactttctagcgctgtgaccttggcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctgg

SEQ ID NO: 2823 - DNA, 3007 bp, Homo sapiens
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtgtggatggccagggtacctggggactcaggctgctgccagttctgctcaccaccatccgtgcttggcacagaagtagctgcatagaaagggcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagtgtaaactacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattagagattgaattgctttccctgggagtgtgcagtatctcattaaaatgttgtatattcaaaaaaatacagacacacacaagtgcctatataatgataaaacatatccaaagcacccaaacctgtgattccagaaaagtagatcctatttttgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 2824 - DNA, 1703 bp, Homo sapiens
cgtggtgcagcgcatattttcacaagtgggtctcccttgtccgggactatggccaccgactcgtgggccctggcggtggacgagcaggaagcggctgtcaagtcgatgaccaatttgcagatcaaggaagagaaagtcaaagcagataccaatggtattatcaaaaccagtaccactgccgagaaaacagatgaagaggagaaagaggacagagctgcccagtccttactcaacaagctgatcagaagcaaccttgttgataacacaaaccaagtggaagtcctgcaacgggatccaaactcccctctgtactcggtgaagtcgtttgaagagcttcggctcccacagaatctgattgcccagtctcagtctggcactggtaaaacagctgcctttgtcttagccatgctcagccgagtggagccatcagacagatacccccagtgtctgtgcctctccccaacatatgagctggcgcttcaaacaggaaaagtgattgagcagatgggcaaattttacccagaactgaagcttgcctatgccgttcgaggcaataaattggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcagaagtagagagaaactacctacctcacttcaaattatgtttggacttgacaaaaataggtgcaaatgatggggggcaatagaagaaaaaatttgcattttggaaaattgggtcctttccccacttttttaaagccacattcccccatctttataataatctggtcacagtggtagtcgctggccccaggaccccctcctgattttggcta

SEQ ID NO: 2825 - DNA, 2731 bp, Homo sapiens
agcctgcgcttcggaagcatggatgtgcgcctgcgctgcgctagggcgcggcgggcggtttgaattttgcttacagagtcccgtctcaccatcctgggcttccaacggagactgcggtatccgcagctggagacccagcggcgagtagccttttgctcccggacggacttgagaggcttaaaggatggcctcgtcagatctggaacaattatgctctcatgttaatgaaaagattggcaatattaagaaaaccttatcattaagaaactgtggccaggaacctaccttgaaaactgtattaaataaaataggagatgagatcattgtaataaatgaacttctaaataaattggaattggaaattcagtatcaagaacaaaccaacaattcactcaaggaactctgtgaatctcttgaagaagattacaaagacatagaacatcttaaagaaaacgttccttcccatttgcctcaagtaacagtaacccagagctggtacatgaaatcccgcttaacctataatcaaattaatgatgttattaaagaaatcaacaaggcagtaattagtaaatataaaatcctacatcagccaaaaaagtctatgaattctgtgaccagaaatctctatcacagatttattgatgaagaaacgaaggataccaaaggtcgttattttatagtggaagctgacataaaggagttcacaactttgaaagctgacaagaagtttcacgtgttactgaatattttacgacactgccggaggctatcagaggtccgagggggaggacttactcgttatgttataacctgagtcccttgtgaacttttgaacataccaacagggtatagagtatagaggctatttctataattttcttatatataatttttttaacttttaatcttttttgtttccttttttttttttttgagacaggatcttgctttgtcacccaggggcttgctttgtcacgcaggctagagtgcagtggcgcaaacatggctcactgcagcctcaacctcccaggctcaagtgatcctcccacctcagccccctgaatggctgggactacaagcgtgcgccaccatgcctggctaatttttgtattttttggagagatggggtttcaccatgttgcctaggctggtcttgagctcctgagctcaaacaatccaccctcctcagcctcccaaagtgctgggattacaggcttgagccaccacacctgacctattcttgtttcttataaaaataaaacttttttggataaagcttatttcttgtttttttctttttctttttttttttttttgagacagtctcgctctttcacccaggccggactgcagcggcgctatctcggctcactgcaaactctgcctcccaggttcacgccatcctcctgcctcagcctcctgagtagctgggactacaggcacctgccaccacgcccagctaattttttgtatttttagtagagatggggtttcaccgtgttagccaggatggtctcgatctcctgacctcatgatccgcccacctcggcctcccaaagtgctgggattacaggcgtgagccaccgcgcccggccaacttatatattttcaagattcacctcctctcaccaaatatttaactacctgctgaatacgcctctgtactaggcacataatggaactaaaaaatgctcatgtccagtttttgtgttgagtgaacaatgctgcagaccctaataagattgggtacagatcggcatgcgcctgtagtcccagctactcaggagaattgcttgaacctaggaggtggaggttgcagtgagccgagatcgtgccactgcactccagtctgggcaacagagcgagactccatctcagaaaaaaagaaaaaaagactgggtacagatgtgatattggaagaaaaagatcaagctgatgaggttaggatacccaggccctttggacttaaagatcactagtgtctaaattccatcgatggcatttcagtctataggtaaacttcctggaagctggatttggagacagtttatcatctgattattgggctttcgtataggtccttagggagcagcttacctgaaatgcatttagtgtacaccagtctgtaaacttcaacctgtaatgaaagtgtaataaatgtacattgagttgatgtgataatgtgatataataagaaatatatatttgatcttcctatctagttccttgttcagagctcctaaaacccttgtaatttccaaagtgatggagtacatcttttgttctagtatttggtctttgaccccagttcctgacacaaagctcctaaattcctttaaatttcccagtgataggagaattttttgttctaatgaggtcactcttgatgggcacctggataactcaggatgggggctgctcacaaagaccacatcatgattggaagtttcaaactttcagtctcccacctccagagaggggagaggggctggagatttgtgtcaataatccatcaggcctatgtcaacaagacataatccgttaactatggagttcagggagcttcagggttggcaaacattttgatgtgccaggaaggtgacgcactccagctttatgaagtcagcaagtcctgtgctcaggatgcttctggaccttgccccaggtaccccttcatgtggctgttgttcatctgtatcctttgtagtagccttaaaataaactgttaaac

SEQ ID NO: 2826 - DNA, 2163 bp, Homo sapiens
agttgccgctgtcgtccgcagagccagttcctagcgcagagccgcgcccgccatgagggagatcgtgcacatccaggcgggccagtgcgggaaccagatcggcaccaaggtgggcctggcgcggtgcagggcctctccgcgggtcggctgctggcgggccccgggtctcccggcgcgacccccgccggggcgcgcacccgctgtgcgcccctgggtcctcggagcccggtgcggacccgcgagggccgcagggagggagcgcccggggcgtggccggccggggaccttctactcttcgctccccacccccatcccaactgggagcggctgccggcggctcaggcgcgcctggaattcggccgccggggcgcctggggtgggcgcgggtggcggcgtcccgggctctgggttctgagcgtctgtccccccgccttgccctgcccaagttttgggaagtgatcagcgatgagcacggcatcgacccggccggaggctacgtgggagactcggcgctgcagctggagagaatcaacgtctactacaatgagtcatcgtctcagaaatatgtgcccagggccgccctggtggacttagagccaggcaccatggacagcgtgcggtctgggccttttgggcagcttttccggcctgacaacttcatctttggccagacgggtgcagggaacaactgggcgaaagggcactacacggagggcgcggagctggtggacgcagtgctggacgtggtgcggaaggagtgcgagcactgcgactgcctgcagggcttccagctcacgcactcgctgggcggcggcacgggctcaggcatgggcacgctgctcatcagcaagatccgtgaggagttcccggaccgcatcatgaacaccttcagcgtcatgccctcgcccaaggtgtcggacacggtggtggagccctacaatgccacactgtcggtgcaccagctggtggagaatacagacgagacctactgcatcgacaacgaggcgctctatgacatctgcttccgcactctgaagctgacaacgcccacctacggggacctcaaccacctggtgtccgccaccatgagtggggtcaccacctcgctgcgcttcccgggccagctcaatgctgacctgcgcaagctggcggtgaacatggtgcccttcccgcgcctgcacttcttcatgcctggcttcgcgccgctcaccagccgcggcagccagcagtaccgggccctgaccgtgcccgagctcacccagcagatgttcgacgccaggaacatgatggccgcctgcgatccgcgccatggccgctacctgaccgtggccaccgtgttccgcgggcccatgtccatgaaggaggtggacgagcagatgctggccatccagagtaagaacagcagctacttcgtggagtggattcccaacaacgtgaaggtggccgtgtgcgacatcccgccccgcggcctgaagatggcctccaccttcatcggcaacagcacggccatccaggagctgttcaagcgcatctccgagcagttctcagccatgttccggcgcaaggccttcctgcactggttcacgggtgagggcatggatgaaatggagttcaccgaggcggagagcaacatgaacgacctggtatccgagtaccagcagtaccaggatgccaccgccaatgacggggaggaagcttttgaggatgaggaagaggagatcgatggatagtcggaatagagccgccccaactcagatcctacaacacgcaagttccttcttgaaccctggtgcctcctaccctatggccctgaatggtgcactggtttaattgtgttggtgtcggcccctcacaaatgcagccaagtcatgtaattagtcatctggaacaaagactaaaaacagcagagaattgcgggttctacccagtcagaagatcacaccatggagactttctactagaggacttgaaagagaactgaggggccacaaaataaacttcaccttccattaagtgttcaagcatgtctgcaaattaggagggagttagaaacagtctttttcatcctttgtgatgaagcctgaaattgtgccgtgttgccttatatgaatatgcagtatgggactttgaaataatgattcataataaaatactaaacgtgtg

SEQ ID NO: 2827 - DNA, 2738 bp, Homo sapiens
gtagaagaggggaggaaacaagccagtgcaaggggagcaaaagagaaaaggagccaggctgggcttcctgatcccacagcatcgcagagctcgggaggcacagctcacagacacaggaaacacaggactgctattctgctctcctgcccacggtgatctggtgccagctggtggaacagtgggtgatggcgtccctgctgcaagaccagctgaccactgatcaggacttgctgctgatgcaggaaggcatgccgatgcgcaaggtgaggtccaaaagctggaagaagctaagatacttcagacttcagaatgacggcatgacagtctggcatgcacggcaggccaggggcagtgccaagcccagcttctcaatctctgatgtggagacaatacgtaatggccatgattccgagttgctgcgtagcctggcagaggagctccccctggagcagggcttcaccattgtcttccatggccgccgctccaacctggacctgatggccaacagtgttgaggaggcccagatatggatgcgagggctccagctgttggtggatcttgtcaccagcatggaccatcaggagcgcctggaccaatggctgagcgattggtttcaacgtggagacaaaaatcaggatggtaagatgagtttccaagaagttcagcggttattgcacctaatgaatgtggaaatggaccaagaatatgccttcagtctttttcaggcagcagacacgtcccagtctggaaccctggaaggagaagaattcgtacagttctataaggcattgactaaacgtgctgaggtgcaggaactgtttgaaagtttttcagctgatgggcagaagctgactctgctggaatttttggatttcctccaagaggagcagaaggagagagactgcacctctgagcttgctctggaactcattgaccgctatgaaccttcagacagtggcaaactgcggcatgtgctgagtatggatggcttcctcagctacctctgctctaaggatggagacatcttcaacccagcctgcctccccatctatcaggatatgactcaacccctgaaccactacttcatctgctcttctcataacacctacctagtgggggaccagctttgtggccagagcagcgtcgagggatatatacgggccctgaagcgggggtgccgctgcgtggaggtggatgtatgggatggacctagcggggaacctgtcgtttaccacggacacaccctgacctcccgcatcctgttcaaagatgtcgtggccacagtagcacagtatgccttccagacatcagactacccagtcatcttgtccctggagacccactgcagctgggagcagcagcagaccatggcccgtcatctgactgagatcctgggggagcagctgctgagcaccaccttggatggggtgctgcccactcagctgccctcgcctgaggagcttcggaggaagatcctggtgaaggggaagaagttaacacttgaggaagacctggaatatgaggaagaggaagcagaacctgagttggaagagtcagaattggcgctggagtcccagtttgagactgagcctgagccccaggagcagaaccttcagaataaggacaaaaagaagaaatccaagcccatcttgtgtccagccctctcttccctggttatctacttgaagtctgtctcattccgcagcttcacacattcaaaggagcactaccacttctacgagatatcatctttctctgaaaccaaggccaagcgcctcatcaaggaggctggcaatgagtttgtgcagcacaatacttggcagttaagccgtgtgtatcccagcggcctgaggacagactcttccaactacaacccccaggaactctggaatgcaggctgccagatggtggccatgaatatgcagactgcagggcttgaaatggacatctgtgatgggcatttccgccagaatggcggctgtggctatgtgctgaagccagacttcctgcgtgatatccagagttctttccaccctgagaagcccatcagccctttcaaagcccagactctcttaatccaggtgatcagcggtcagcaactccccaaagtggacaagaccaaagaggggtccattgtggatccactggtgaaagtgcagatctttggcgttcgtctagacacagcacggcaggagaccaactatgtggagaacaatggttttaatccatactgggggcagacactatgtttccgggtgctggtgcctgaacttgccatgctgcgttttgtggtaatggattatgactggaaatcccgaaatgactttattggtcagtacaccctgccttggacctgcatgcaacaaggttaccgccacattcacctgctgtccaaagatggcatcagcctccgcccagcttccatctttgtgtatatctgcatccaggaaggcctggagggggatgagtcctgaggttgcaactagaaattcagaggggcttggaatagagaaacctaaagaagcatcatcccctccatccccaacttcctcaaagcccaaagccaagggaaggataaatcaaggctcaaggcttccccagcaaagattagggaaagagacttgaccccaggactgtactacgactcttaagagaacactgcacagcactcaaagtcccccactggactgcttcctccttagccccactggtataaatacatctctctccaatttggc

SEQ ID NO: 2828 - DNA, 1567 bp, Homo sapiens
cgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaagtggttgcttagatttaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccagcccctgctggctctgctggcactcctccccttcctgctacttctgcatctgcccctgctcctcttgttcctgctactgtcccttcctccactgccccagacgctgctgctgggggtgcccagacccttgctgatggcttcacttctccaactccccctgttgtttcttccactccccctacaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatg

SEQ ID NO: 2829 - DNA, 2352 bp, Homo sapiens
caggagaggtagccgagggagcctgacgggtgacgccagcggccacggggccccgaacgagcaggacatgaggggcgactaggcgcgaggacgagcaaaagcaagtggatgacagcatgaacggccctgcggggctggccggacggctgcaagaacatgctgagcccaaagatcaggcaggccaggagggcccgctccaaaagcctagtgatgggggagcagagccggagccctgggcggatgccgtgccctcacaggctgggccccgtgctgaaggcgggctggctgaagaagcagaggagcatcatgaagaactggcagcagcgctggtttgtgctgcgtggggatcagcttttctactacaaggacaaagatgagatcaagccccagggatttatttctctacaagggacacaggtgactgaacttcctcctggccccgaggacccagggaagcacctctttgagatcagcccaggtggtgccggggagcgggagaaggtgccggccaaccccgaggcgctcctgctcatggccagctcccagcgtgacatggaggactgggtgcaggccatccgccgagtcatctgggccccgctgggcggaggtactgcccgtagatcgcatgcccaccctctagaacccttgcctccagggatctttgggcagcgcctagaggaaacagtccaccacgagcggaagtatggcccccgcctggcgcccctgctggtggagcagtgtgtggacttcatccgggagcgcgggctcactgaggaggggctgttccgcatgccaggccaggccaacctggtgagggacctgcaggattccttcgactgtggggagaagccactgtttgacagcacaacagacgtgcacacggtggcctccctgctgaagctgtacctgcgggagctccccgagcccgtggtccccttcgccaggtacgaggacttcctcagctgcgcccagctgctcaccaaggacgagggggagggcactctggagttggctaaacaagtgagcaaccttcctcaggcaaattacaacctgctcagatacatctgcaagtttctggatgaagttcaggcatactcaaatgtcaacaagatgagtgtccagaatctggcaaccgtttttggacctaacattctgcggccacaggtagaggacccagtaaccatcatggaaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggaccaggaaaagaaaaaatacatcatgctggaaataaagctgcggaactctgaacgggcgcgggaggatgcggagaggaggaaccagctgttgcagagggaaatggaggagtttttttcgaccctaggaagcttgactgttggggcaaaaggtgccagggccccaaagtaaaaggaatggcagagctcacttctgtaccacgtctgctggtctccagccttg

SEQ ID NO: 2830 - DNA, 567 bp, Homo sapiens
aggctaggcgtggacccaactggcgaggctgctggggttgcagcgggacagttggggcggccccgcaggcccaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatttcaacatcatggatatagtggcccaaatgagagaacaa

SEQ ID NO: 2831 - DNA, 3086 bp, Homo sapiens
aggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggaatcaattcatttacagctttccagtttttccagcctgcaagaggaggataaatctaggaaagatgactctgaaagagaaaaagaaaaggataaaaacaaagataaaacctctgaaaaacccaagatcagaatgttatcaaaagattgcagccaagaatacacggattctacaggcatagacttacacgagtttctgattaacacattaaagaataattccagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaataccagagcaaaggttttgtgaacatttaaaagatgaaaaaggtgaagaatcccagaagcggtttatcttgaagcgagataactctagtattgataaagaagacaatcagtcagtttgctcccaggaaagcctttttgtggaaaacagtaggctcttggaagacagtaacatatgcaatgagacctataagaaaagacagctctttcggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggccagccctttgtgaatcccgatggaactcctgcaatatacaacccacccaccagtcagcagcccctgcgaagcgccatggtggggcagtcccaacagcagccaccacagcagcagccctccccgcagccccaacagcaggtccagccaccgcagccacagatggcaggccctctggtcactcagtctgtccaggggctgcaggcttcctcccagtcagtgcaatatccagcagtctcttttcctccccagcacctcctacctgtgtctccaacgcagcactttcccatgagagatgatgtggcaacacagtttggccagatgaccctgagccggcagtcctcgggggagactcctgaacccccatcaggtcctgtctacccatcctcccttatgccacagccggcccagcagcccagctatgtaatcgcctctacaggccagcagcttcctacaggaggattctcaggctctggccctcccatctcccagcaggtcctccagccccctccctcaccacagggatttgtgcaacagcctccgcctgcacagatgcctgtatattattacccatctggtcagtaccctacctcaaccacgcaacagtaccggcccatggccccggttcagtacaacgctcagaggagtcaacagatgccacaggcagcacagcaagcaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacatt

SEQ ID NO: 2832 - DNA, 2378 bp, Homo sapiens
cctgctcgttcctgacagaattaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcaggtaccatcaacagtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatac

SEQ ID NO: 2833 - DNA, 603 bp, Homo sapiens
gtgcaggagcgggacccggaacagaccgccgtgagagaggaggggtgccggccgggattcgcggcccggagctcgggaccggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaagga

SEQ ID NO: 2834 - DNA, 650 bp, Homo sapiens
gtctcccggccacggttgaaaccagacgtgcagtggggctgacccctgtgccccaccccagagtcatgccagcgtgggtggtggggcattctctgggatgaatgatctggatcccatagccatctgtgtcctgtttgaggaatgggaccctcaaacagagaacagccaagatgctcaagcagtgatttatctctagggtctccatagcaggggaggtagggtcagactcctgagatggctgatgtcctaccctgcccccaaccaggggccccaggagactcctttttcttactgcaactttggcctcctcagtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctg

SEQ ID NO: 2835 - DNA, 622 bp, Homo sapiens
ctttccagaagacattccaaccaccatggtagagtcacagtaatgtcatggagaatgaagggagtcggggactaaacaagtggctgcaggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagctcgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggta

SEQ ID NO: 2836 - DNA, 576 bp, Homo sapiens
gtgtcctccggtcccctctgcctcaggcagctgcatgtttgcctctgacctcctcagggctttagattgctgccctggggcgggaagctccggcctcctcccccagctgggcccccgacagctcctggcattcacagtgaactgtctggggaatcatcgctatttggggttcttcgaggacctggagcagcggcacaaggcccaggtgctggtcgaggacatcagtgacatcctggaggagcacgctgagaagcacttccacccctacatcgcctactgctccaacgaggtctaccaacagcgcacgctgcagaagctgataagcagcaacgccgccttccgagaggccctgagagagattgagaggcggccggcgtgcgggggcctgcccatgctctccttcctgatcctccccatgcagcgggtgacccggctgcccctcctgatggatacgctctgcctcaagacccagggccactccgaaaggtacaaggctgccagccgtgcactgaaggccatcagcaagctggtgaggcagtgcaacgagggggcccacaggatggagcgcatggagca

SEQ ID NO: 2837 - DNA, 3122 bp, Homo sapiens
cttcctaagccttaaagagacaggacggtcgattggtctgaaattcttgaagagacaggcgcccgctccggccggcaccatggacagcgaggcattccagagcgcgcgggactttctggacatgaacttccagtcgctggccatgaaacacatggatctgaagcagatggagctggacacggcggcggccaaggtggatgaactgaccaagcagctggagtcgctgtggtcagactctcccgcgcctcctggcccgcaggccggacccccttctaggccgccccggtacagctccagctcgatccctgagcccttcggcagccgagggtccccccggaaggcggccaccgacggcgcagacaccccgttcggacgatcagagagtgccccaaccctacacccctacagcccgctgtcccccaagggacggccgtcgtcgccgcgcaccccgctctacctgcagccggacgcctacggcagcctggaccgcgcgacctcgccccggccccgcgccttcgatggcgcaggcagctccctcggccgtgcgccctccccgcggcccgggccaggcccgctccgccagcagggtccccccacgcctttcgacttcctgggccgcgcaggctccccccgcggcagccccctggcggaggggccccaggccttcttccccgagcgtgggccgtcaccgcgcccccctgccacagcctacgacgcgccagcgtccgccttcgggagctccctgctaggctccggcggcagcgcattcgccccgcctctgcgcgcgcaagacgacctgacgctgcgccggcggcctccgaaagcctggaacgagtctgacctggacgtggcgtacgagaagaagccttcgcagacagcgagctatgaacgcctggacgtcttcgcaaggcctgcctcgccgagcctgcagctgttgccttggagggagagcagcctggatggactggggggcaccggcaaggacaacctcactagcgccaccctgccgcgcaattacaaggtctctcctctggccagcgaccggcgttcagacgcgggcagctaccggcgctcgctgggctccgcggggccgtcgggcactttgcctcgcagctggcagcccgtcagccgcatccccatgcccccctccagcccccagccccgcggggccccgcgccagcgtcccatccccctcagcatgatcttcaagctgcagaacgccttctgggagcacggggccagccgcgccatgctccctgggtcccccctcttcacccgagcacccccgcctaagctgcagccccaaccacaaccacagccccagccacaatcacaaccacagccccagctgcccccacagccccagacccaaccccaaacccctaccccagccccccagcatccccaacagacatggccccctgtgaacgaaggaccccccaaaccccccaccgagctggagcctgagccggagatagaggggctgctgacaccagtgctggaggctggcgatgtggatgaaggccctgtagcaaggcctctcagccccacgaggctgcagccagcactgccaccggaggcacagtcggtgcccgagctggaggaggtggcacgggtgttggcggaaattccccggcccctcaaacgcaggggctccatggagcaggcccctgctgtggccctgccccctacccacaagaaacagtaccagcagatcatcagccgcctcttccatcgtcatggggggccagggcccggggggccggagccagagctgtcccccatcactgagggatctgaggccagggcagggccccctgctcctgccccaccagctcccattccacccccggccccgtcccagagcagcccaccagagcagccgcagagcatggagatgcgctctgtgctgcggaaggcgggctccccgcgcaaggcccgccgcgcgcgcctcaaccctctggtgctcctcctggacgcggcgctgaccggggagctggaggtggtgcagcaggcggtgaaggagatgaacgacccgagccagcccaacgaggagggcatcactgccttgcacaacgccatctgcggcgccaactactctatcgtggatttcctcatcaccgcgggtgccaatgtcaactcccccgacagccacggctggacacccttgcactgcgcggcgtcgtgcaacgacacagtcatctgcatggcgctggtgcagcacggcgctgcaatcttcgccaccacgctcagcgacggcgccaccgccttcgagaagtgcgacccttaccgcgagggttatgctgactgcgccacctacctggcagacgtcgagcagagtatggggctgatgaacagcggggcagtgtacgctctctgggactacagcgccgagttcggggacgagctgtccttccgcgagggcgagtcggtcaccgtgctgcggagggacgggccggaggagaccgactggtggtgggccgcgctgcacggccaggagggctacgtgccgcggaactacttcgggctgttccccagggtgaagcctcaaaggagtaaagtctagcaggatagaaggaggtttctgaggctgacagaaacaagcattcctgccttccctccagacctctccctctgttttttgctgcctttatctgcacccctcaccctgctggtggtggtccttgccaccggttctctgttctcctggaagtccagggaagaaggagggccccagccttaaatttagtaatctgccttagccttgggaggtctgggaagggctggaaatcactggggacaggaaaccacttccttttgccaaatcagatcccgtccaaagtgcctcccatgcctaccaccatcatcacatcccccagcaagccagccacctgcccagccgggcctgggatgggccaccacaccactggatattcctgggagtcactgctgacaccatctctcccagcagtcttggggtctgggtgggaaacattggtctctaccaggatccctgccccacctctccccaattaagtgccttcacacagcactggtttaatgtttataaacaaaatagagaaactttccttataaataaaagtagtttgcacagaaattga

SEQ ID NO: 2838 - DNA, 6548 bp, Homo sapiens
gctcggcccgggctgccacgagcgtgcgggcctcgccgggcatgtcctaggcggcggccccgcccagcgctcggccgggcgggcgggcgggcgcgagggcagggaccgagccgggccgagctggggaacaagccggggaccaagccggggaccaagccggggactaaggcgagccggagaccgagcccgaacagcagtcccgcagcgtggacaagcagcatgccgtcatcaactacgaccaggacagggacgagcactgggtgaaggacctgggcagcctcaatgggacgtttgtgaatgacatgcgcatcccggaccagaagtacgtcacgctgaagctcaacgatgtcatccgcttcggctacgattccaacatgtatgtgctggagcgtgtgcagcaccgagtcccggaggaggcactcaagcatgaaaagtacaccagccagctgcaggtgagcgtgaagggtttggcgcccaagaggagcgaggcactgccggaacacacaccatactgcgaggcctcgaaccccaggccggagaagggggaccggagaccaggaacagaggcagcctcttaccgcacacccctgtatgggcagccctcctggtggggtgaggacgatggtagcacgctgcctgacgcccagcgccagggagagccctacccagagcgccccaagggaccagtgcagcaggacggggagctccacggcttccgcgcccctgctgagcctcagggctgctcgttccggcgggagcccagctacttcgagatccccacgaaggagaccccgcagccgtcgcagccccccgaggtgccggcacacgagatgcccacgaaggatgcagaggcaggtgggggcggagcggcccctgtggtgcagagccacgcctccttcaccatcgagtttgatgactgcagccctggcaagatgaagatcaaggaccatatcaccaagttttccctgcgccagcggcggcccccgggcaaggaggccacacctggcgagatggtgtcggctgagaccaaggtggccgactggctggtgcagaatgacccgagcctgctgcaccgggttggccctggggatgaccgccacagcaccaagagcgacctgcctgtccacacccgcaccctgaagggccacaagcacgaggacggcacgcagagtgactcagaggaccccctggccaaggcggcctcggccgctggggtgcccttggaggccagcggggagcaggtgcggctgcagaggcagatcaagcgggacccccaggagctactacataaccagcaggcctttgtcatcgagttcttcgacgaggacacaccccgaaagaagcgctcccagtccttcacgcacagcccgtccggggaccccaaggccgacaagcgccgtggcccaacgccggccgatagggaccgccccagtgtcccagccccagtccaggcagggggccgcagctcggggccacagagggccggctcgctcaagcgggagaagacagaggaacggctgggcagcccctcgcccgcctcccgaacccctgcccgccccttcggaagcgtggggcgccgctcccgcctggcccaggacttcatggcccagtgtctgcgggagagctccccggccgcccggcccagccccgagaaggttcctccggtgctgcccgctcccctgacaccccatgggaccagccccgtgggccccccgaccccaccgcccgcccccacggacccccagctgaccaaggcacggaaacaggaggaggacgacagcctcagtgacgcagggacatacaccatcgagaccgaggcgcaggacacggaggtggaggaggcccggaagatgatcgaccaggtctttggggtgttggagtcccctgaactctccagggcatcttcggccacctttcgcccagtcatcagaggggacagagatgagtctgatgacgggggcgtggcccagcggatggcgctactgcaggagtttgcctcccggccactgggtgcggccccccaggcggagcaccagggcctcccggtgccgggctcccctgggggtcagaagtgggtgtcccgctgggccagcctggctgacagctactcagacccgggcctcacagaggatggcctgggacgtagaggcggggagccggaggggtccctgcctgtgcgcatgcggcgacggctccctcagctgcccagtgagagggctgacagccctgcgggcccagagagcagcaggaggagtgggcctgggccaccggagctggacagtgagcagcccagccgcctcttcggccaggaggagttggatcctgacagcctcagcgatgccagtgggtcggacgggggccgaggccccgagccaggggtggagccacaggacagcagacgcaggagcccccaggaggggcccacgtggagcaggggtcggcgctcaccaagggcccccggggagccaactcccgcctctttcttcattggggaccagaatggggacgctgtgttatctaggaaaccgcttgcggctccaggggatggggagggcctagggcagacagcccagcccagccccccagcacgggatggcgtctatgtcagtgccaatgggagaatggtcatccagctacggcctggacggtccccagaacccgacggccctgccccagcctttctccggcaagagagcttcactaaggagccagccagtggtcccccagcgcccggcaagcccccccacatctccagccacccgcttctacaggacctggccgctacccgggccgcacgcatggacttccactcccaggacacccacctgatcttgaaggagacggagacggccctggcggccctggaggcccgactcctctctaattctgtggatgccgagtgtgaggggggcagcaccccgaggccgccggaggacgccctgtctggggactcggacgtggacacagccagcaccgtcagcctgcgtagtggcaagagcgggcccagccccacaaccccccagcctctgcgggcacagaaggagatgtcgccatccccgccagctgcacaggacccgggaggcaccgccctggtcagtgcccgtgagcagtcctcagagaggcagcatcacccacttggcccgacggacatgggccgtggagagccggtacggcgctcagccataaggcgtggccacaggccccgagggtccctggattggcccagtgaggagcgtggccctgtcctcgcccacctacccagctcagatgtgatggcctccaaccacgaaacccctgaggccaccggggcaggacggctaggttctcgccggaaaccagcggccccaccgccatccccagctgcccgggaggagcagagccgtagctcagccagctcccagaaggggccgcaggccttgacccgctccaacagcctgtccacccctcgccccacacgggcctcccggctgaggcgggcccggctgggggacgcttcagacactgaggctgcggatggtgagcgggggtccctgggcaaccctgagcccgtgggccggccagctgctgagcaggccaagaagctgtcacgcctggacatcctggccatgccccggaagcgggccggctccttcacagggactagtgaccccgaggcagcccctgcccgcaccagcttctctggccgcagtgtggagttgtgctgtgccagccgcaagcccaccatggccgaagcacgggctgtctccaggaaggctgccaacacagccaccaccacgggtccccgccagcccttcagcagggcccgctcaggcagtgcccgatacacctccaccactcagaccccgagggctggcagctccagccgggctcgttcccgggcccccggcccccgggacacggacgacgatgaggaggagcctgacccttatggtttcatcgtgcagacggcagagattgcggagattgccaggctgagccagacgctggtgaaggacgtggccatcctagcccaggagatccacgatgtggctggggacggtgacacactgggctcctcggagcctgcccacagcgcctccctcagcaacatgcccagcacccccgcctcgaccatctctgcccgggaggagctggtgcagcgcatccccgaggccagcctcaacttccagaaggtgccgcccggctcgctgaactctcgggactttgaccagaacatgaacgacagctgtgaggacgccctggccaacaagacgcggcctcggaaccgagaggaggtgatcttcgataacctgatgctgaacccggtgtcccagctgtcgcaggccatccgtgagaacacagagcaccttgccgagaagatgaagatcctctttcagaacacagggagagcttgggaggacctggaagccaggatcaacgccgagaacgaggtgcccatcctgaagacatctaacaaggaaatcagctccatcctgaaggaactgaggcgggtgcagaaacagctggaagttatcaatgccatcgtggaccccagtgggagcctggacctgctcacaggaaacaggagcttggccagctctgcacagccggggctggggaagggccgcgtggctgcccagagcccaccctcacccgcctcagccgaggccctgctgccagccctgcccctgaggaatttcccacagcgggccagctgtgggcctcccagcctcccggaccccaccttcctccctgatgccgagaggttcctgatctaggccccagacctggccaggccagcctccctgtgcgtgtgcgtctctgccttccgtccgccgcacacccgcctgcctggccgcaggtggttctccctgaagacccccacatgtgccatatccctgtgggcgggtgcctcccacgcccttgccccctcgtcagctcccagccagcaccctactcaccctgtccagccccatggccacccccacccctgcctcgccccctacaggcctctgggcccagctcctggccaggctgctgccaaggtcaagccctcaagggcattaccccgcctcctcttcatcactgttatttttgtctttagctttaaaggaaagagttgttggtgccattgcaggtgccccctccaggcctgactggctccgccaggcactaacctgccataaccctttgtgctggcctgcggccaggcagaggaagagaggtcgactgtggggtcatttggtgccaaacatggaggtgggcaggctcacctgttcctgggactgtctgagatggcagggcacttgccctggtggctcccacctgaccccaggccttttataggcaggagccccactgcttccagcctctggtgccaacacagttgccaaacccattgagcttggggctgccctgtggaggcctcctgggtatggaccaggggcttgttgagagctgagccatgcacacaggtgcagacaccccccaactcccatgcacacggctagtccaggcgcctccacgctgcaccgtgaggactgcagggcatgtccccgtgaggggctatgggcctctgtaggtgggcttccaaggtcctgggtgcagccgggtgcatggcagcccttctggcgggggtgagcgcacgaccaaagtcactggaagccgggtttccggaagctcgcagcttggcctgcaccacacgccctccccttttggcttcacgccatcaggcctcaagtgggcatgggggcagggacgggcccaggaactgttgttttctcaggattctttcagctgggaacatggcaggtgagcagagcttggtgcctctgccgtggcccctgctggggcagcccgtgttgccggagcctctaagccaaagagcccgttggccgtggttggtgggggtggacgtgggggtgtcccacctggaccagactggcgtgggtgagctccacaccctgcctggcaatggtatgagagtcggacctggacagggccagctgctgggggagcggcactggggactggaggctggaagcgggtggtgtgtgtcccctgtttacttttagctgagctggggttgggtgtacgggttctgttcctctgagcctgcggcccacctgatgtttacgtgtgtgtgtgagggggggcgggggtggcaggtgtccccccctggtccccgccccaagagcctgctgtctgtatggaggaggtgctagcccggtccaccgggctgctgcccacccctgcatgccccagttgcccaccccgcctgcccctggacatgaagtggtcacgcttcatccacggctccttcccacccctcggcagtggctgtgcaatgttttaagttcacaagttcctgctcctccccacactgagctcctttgttcctccccctccagcctttgcctgggaactggtccttgtttgccgggcttctcggagggttcactgtacattcgttctcaggtggtcttgtggctgtctttcggaaaatggttattttatatgatttgtcatggaatttgttctaataaatcattcttctatcacatggcagc

SEQ ID NO: 2839 - DNA, 458 bp, Homo sapiens
ctcagtagcttcatctatagtatcagcataacaataattgagcagttttacctggctcacagcaaggactcggctatggcaaattttattttattttaattattttgttttatttttatttgtatcttattttattttttgagacgaagtctcactcttcacccaggctggagtgcagtggcacaatctcagctcactgcaacctctgcctcccaggttcaagcaatcctcccacctcagcctcctgagtagctgggactatagcaagagcctcctgatctagcagccaagactccccctgacctttggccatgtaccccaaccctctcatctactgcacctgctgggacccctggaacttgggaccacggaagctaatcaagacccctcaactaccacgcaagaactccacagggagttccaagctaactcctcttgtaccagctccaaaaaatcac

SEQ ID NO: 2840 - DNA, 1457 bp, Homo sapiens
ccagggcgcggtctggaggctcacgggagagaggctgtagccctgggcaatcccgggggtcgttacaggaaggtaggaaaatgccaccctcagggcactggttgggctaaaggtgacactggcgtctcacgggctatgaagacggaatgcctcttaatgccggaattccaagacggaatgcctcttaatgccgggcaagtctcacatgaagctactcatcatttgcttcgtgtcctccgagctccgagagttggcaaagctgatgaaggagcagtagacagcgacccaagcacaccacttcagctagggaaagaccgatttaaggctgcaaggaaggagtcctgggagcatggctttccctgagccaaagccgcggcctccagagctgccgcagaaacggttgaagacgctggactgcgggcagggggcagtgcgagccgtacgatttaatgtggatggcaattactgcctgacgtgcggcagtgacaagacgctgaagctgtggaacccgcttcgggggacgctgctgcggacgtacagcggccacggctacgaggtgctggatgcggccggctcctttgacaacagtagtctctgctccggcggcggggacaaggcggtggttctgtgggatgtggcatcagggcaggtcgtgcgcaaattccggggccacgcagggaaggtgaacacggtgcagtttaatgaagaggccacagttatcctgtccggctctattgattccagtatccgctgttgggattgccgctcacggaggcctgagccagtgcagacgctggatgaggccagagatggcgtgtccagtgtgaaggtgtcagaccacgagatcctggcaggctccgtggatggccgcgtgagacgctatgacctaaggatggggcagctcttctcagactacgtgggcagccccatcacctgcacctgcttcagccgggatgggcagtgcaccctggtgtccagcctggactccacattgcggctcctggacaaagacacaggggagctgctgggcgagtacaagggccataagaaccaggaatacaagctggactgctgcctgagcgagcgtgacacacatgtggtcagctgttctgaggacgggaaggtgttcttctgggacctggtggagggtgcgctggctctggccctgcctgtgggttccggtgtggtgcagtcgctggcctaccacccaacagagccctgcctgctgaccgccatgggaggcagcgtccagtgctggcgagaggaggcctatgaggcagaggatggagcaggctgaagccaggggacccaccaacaggaccaaggaccgagacacagacatggaaggacttcagataccatcttattctagagacgtagctgaccaaaaagtaggggaggggctgggtctgcaaattaataaatagaagagggggtaagaccttcctgggaccgca

SEQ ID NO: 2841 - DNA, 5529 bp, Homo sapiens
gatttgggagttgggaggtgagatgattggagtgaagagagttaatgtcatggaaaggaaaagctgtctgaagaaaaatacacattttaatgtccctcttcagccgtgcctgctgagagctctcctgggatgataagtgaaagtgtttggatttttttttaagttttaaaactctgccaaagcattgctcagtgtatctgggcagccccttccggcaaaacgcagcagtagcagaggcagcttctgagagcctgggcaggcagcagctggctgaccaagtccactggaagagaaggcttgtgccagccgggagaaggaagccggggacaggatgaaagcaacaacacctttgcagacagtcgaccggcccaaggactggtacaagacgatgtttaagcaaattcacatggtgcacaagccgggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaaggtggggatgatagcaaaatatgtccatccctttgcagttactcagggctcaacggcaacccctccagtgagttagattactgtagcacttacagacagcacttggatgtccctcgggactcaccaagagccattagtttcaagaacggctggcaaatggcccggcaaaacgcagaaatctggagcagcacggaagaaaccgtctctcccaaaatcaaatcccggagctgtgacgatctcctaaacgacgactgcgatagcttcccggacccgaaagtcaagtcggaaagcatgggctccctgttatgtgaggaggactccaaggagagctgccccatggcgtgggggtccccctacgtcccggaggttcgcagtaacggcagatcaaggatcagacacaggtcagcccgcaacgccccggggttcctgaagatgtacaagaaaatgcaccgcatcaaccgcaaggacctgatgaactccgaggtgatctgctccgtgaagtccaggattctgcagtacgagagcgagcagcagcacaaggacctgctgcgcgcctggagccagtgctccacggaggaggtgccccgggacatggtgcccacacgcatctccgaattcgaaaagctgatccagaagtccaaatccatgccaaatttaggggatgacatgctgtctcccgtaaccctagaaccaccgcaaaatggcctatgtcccaagaggcggttttccattgagtatttgctggaggaagaaaatcaaagcggcccccccgctcggggccggcgaggctgccagtctaacgccctggtgcccattcacattgaagtcaccagcgatgagcagccccgagcacacgtggagttttccgacagcgaccaggacggggttgtgtccgaccacagtgactacattcacctagaggggtcatccttctgcagtgaaagtgactttgatcacttttccttcacatcctccgaaagcttttacggatccagccaccaccaccaccatcaccaccaccaccaccaccgccacctcatcagctcctgcaaaggcaggtgcccggcctcctacactcgatttaccacaatgttaaaacacgaaagagccagacacgaaaacaccgaggagcccagaaggcaagaaatggaccctggcctttctaaacttgcttttctagtcagtcctgtgcctttccggaggaaaaaaaattcggctcctaagaaacagactgaaaaggcaaaatgtaaagcatctgtgtttgaggctctggactctgcccttaaagacatctgtgaccaaattaaagctgaaaagaaaagggggagcttgccggacaacagcatcctgcaccgcctcatcagtgagctgctgccagatgttcccgagaggaactcatccctgagagcgctgaggaggagccccctgcaccagcctctccacccactgcctcccgatggtgctattcattgtccaccctaccagaatgactgcgggagaatgccccgcagtgcctctttccaagacgtggacacagccaacagcagctgccaccaccaagaccgtggcggtgcactccaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatggttcacagtgcctgaattacacctgctccgaaaactagctttgtatttcttatgactttgcataagaactgttcatctttggatcttgagcaccttacagataaaactttttatggcatctctttcatggacagtgatattgatcttttcacaatgtacgtagcctctagaattttgtacatatgtttgctctttttttgtacagactagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtatacttcagtttttcttcttgacatttatctttataaaaattgtgtattttattccaacttgttaaactaagagaaaatgca

SEQ ID NO: 2842 - DNA, 1107 bp, Homo sapiens
cgcggggaaaatggcggcggcggcggcggcggctgcagctacgaacgggaccggaggaagcagcgggatggaggtggatgcagcagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagca

SEQ ID NO: 2843 - DNA, 1867 bp, Homo sapiens
cttcactgcgcaggcgccgagcggccgaggcgccgcggtcggctctgggactcgtctggcgtccctcagattgctgacagaactggaatctcctgcttggtggccctttagctccaagctttggaagacaccaccggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacgacatcaaggtccactcaccttacgaaattagcatccgccagcggtttattggaaagccagacatggcctatcgtttgatatctgccaagatgccagaggttatccccattttagaagtgcagttcagcaagaagatggagctgttagaagatgcattggtgctcagaagcgcaagaacctcttcccccgcagagaagagctgctcagtctggcatgcagcatctgggctgatgggccgtaccctgcaccgtgagccacccgcaggagaccaggagggcacagcactgcacctgcagacaagcctgccagccctttctgaggcagatacccaggaactaacccagggcttccggcctatgtcgctgtcaacccagacagtgttggtgatgctttgctccgagtctgcaggagctttgtggagacagagactttcctagcagggcagcaagcggaagcttttcttccagaacagcctttgctcagggcatgagggagccggccaggcccacagcgcccagggcatcctcctcacggatgtgttggaggaaagtggctttggtgctatcctgggggaccatggccataagctggcagtgtcagccacgcatcagttgcgtttctttgttcaggttgtgcctcttgctgcctgcctgagtcacccagggctgctccccttcctggctctgacgccctcagcgggtcccacaagccgctcaggaccacagagtctggccatgggtctggccaggcatccactgatgctctaagctgcagcttctcttaggaacacttctatcaggtctggctcgcaggcatgccccagggccagcctggattgtactgtccttcaagcactccttgctctatttctttgaagtttataaaagtttgtttcccccaaaacccaaagcacttttaatcaggtagtttctgtggaggtcgaactggctggaaggaaggctggttcctggatttctttactcatgtagcagggactcaaggaagtctgatttgcgcctcgcctctgactcagagcccatgaaggttcctgtgtgaggccactggctgcctcggagctgacagcatcctgcacaatggctagatggcttgtcaccccaggccgcagaggaacaactgtttctagggtttggccagacttcacattctccattctttccatccctgttatgtggaatgcacacgatgccatgtaattacttcagtcccttctcaaaggaaaaagaatctggacctgcactccaggacactagcagtttgaaggttcgctcaggaatgttctttgtctgcagacctagcagctgtacagatcgctcttgtgtttttgcactattaattaacttcaagtgcaattttggcaggcaggccaagggtctcaacaggctatttggaatgagttctcttttaaggccttcaacgtagtgagacattttcaaatcaaaaagtacagcaggagccagcctttattttgtctgtgtacacaataaaatattccgcttctataggca

SEQ ID NO: 2844 - DNA, 1890 bp, Homo sapiens
gcggaggcccggcgtgacaagcggcccagactcccgtgggcgccgcacacctgttgtttgcagcagccagcgacccgcactaccgctctcggcgggcggggaagcggccgcagcggagccgacccggcaggtggccgcgggcggggccggcgagcgaaagtgcgcgggggcccgaccaccgcggggccgggacgcgatggcggcggcagagcccgcgagctcgggccagcaggcgccggcagggcaggggcagggccagcggccgccgccgcagcctccgcaggcgcaagccccgcagccgcccccgccgccgcagctcgggggcgccgggggcggcagcagcaggcacgagaagagcctggggctgctcactaccaagttcgtgtcgctgctgcaggaggccaaggacggcgttctggatctcaaagcggctgctgatactttggctgtgaggcaaaaaaggagaatttatgatatcaccaatgtcttagagggaattgacttgattgaaaaaaagtcaaaaaacagtatccagtggaaaggtgtaggtgctggctgtaatactaaagaagtcatagatagattaagatatcttaaagctgaaattgaagatctagaactgaaggaaagagaacttgatcagcagaagttgtggctacagcaaagcatcaaaaatgtgatggacgattccattaataatagattttcctatgtaactcatgaagacatctgtaattgctttaatggtgatacacttttggccattcaggcaccttctggtacacaactggaggtacccattccagaaatgggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcaggatctattagtggagatatcattgatgagttaatgtcttctgacgtgtttcctctcttaaggctttctcctaccccggcagatgactacaactttaatttagatgataacgaaggagtttgtgatctgtttgatgtccagatactaaattattagattccatggaaacttgggactgttatctacctctaactgtgtaacattttagacttcttaataacctaaatatttaaaataatgaatgtaacaccttttttagttcactgattctgaagtgttcttccctaatactttctttacttcacaaaacttcaaccataaaaacaaagggctctgattgctttaggggataagtgatttaatatccacaaacgtccccactcccaaaagtaactatattctggatttcaacttttcttctaattgtgaatccttctgttttttcttcttaaggaggaaagttaaaggacactacaggtcatcaaaaacaagttggccaaggactcattacttgtcttatatttttactgccactaaactgcctgtatttctgtatgtccttctatccaaacagacgttcactgccacttgtaaagtgaaggatgtaaacgaggatatataactgtttcagtgaacagattttgtgaagtgccttctgttttagcactttaagtttatcacattttgttgacttctgacattccactttcctaggttataggaaagatctgtttatgtagtttgtttttaaaatgtgccaatgcctgtacattaacaagatttttaaaaataaaattgtataaaacattcaa

SEQ ID NO: 2845 - DNA, 261 bp, Homo sapiens
gcgcctcggcccgggccttactctccaccgactgcgtcaggatgagctccaggttttctttgggccgatgcttcgtgtcctccaccagcttatagacgcgatgtcgccggtgcaggcgcggcttccggccctccccggccagcggtaccttccaccagcgctccacgatgaccgtgccctggcggccaggaaagcgacgcatcacttataaggaagaggaggacttgacactccagccccgttcctgcctccagtgctcct

SEQ ID NO: 2846 - DNA, 557 bp, Homo sapiens
aatttgaagggtttcttgtagagagaaatgcacattttgacgtacatttgattcaagtgcagggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaac

SEQ ID NO: 2847 - DNA, 565 bp, Homo sapiens
gagcggcggtaagtgagccgcggcgggcgagggtgtagtggggtcttgctgggccggttttggaggcctggagtcaaggggcgagctcgccagggagggcgagggtcacagcaagtctcaggatcctcctctgccagtttctgggtggtccttcctcctccagggactcactgattccggctggcgcccttcgtctgtagccgcgtcccctcagactggttcagtccggggtcttctgacttggaagctcgtgctgatttcctaagtcagcccctcctgtcctcttggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataaca

SEQ ID NO: 2848 - DNA, 3700 bp, Homo sapiens
ggtgaaaaccggcagaaagacattaagagattttcctgcagtcactgctggcagatgatagagccaggatttgaaagcaggcagcctggctccagaccctgtgctcttaactcccgttttgcatcaagaacagaatcctatgaaaggcttgcacagtgcttggtactgagtaggcactccgtcagtattttagtagctattattccaaaggacactgtattctaggtactaagacaatgtgaatggaatggaaaacaattcctccctgcagaagccaactgtctaggaagacagataatgacattattaaaataatcagaacattggcaaaataaagaagattgaaatgcagttcatatgacagtgctaattaatcatactttttagatctaggaaaggccataaaggttaaattgacttggaaatggtaaacaagacaatggttgtgtcactgatcggtgatggccagtttttggttatccttatttgccatttaaatgattgaattgaaaggaagaagtaagacttggaagatgaatattgaaggaaaggtgaagatggaaaagagaagggggtttattctgagaacagtgactagaactctgaggtatggtagaaatttcaggataacagatgataaaggggaatgaagccatggagaggaagagaatgataatattaattgtgaaagtttgtgtcaagtgttttctgagtcacctttctttcagtttctcatttctagtattgtataaatgagtttaacatcaaaatggtatagtgaaaaaaaggatgaactgcttgacagaagaggtcagatctagttttgactctagcttatttagctttacagctttaaataaattacagtgtctttaaagctctggatcttaagttttctaattgttttttaaacaaagatttgtgaacacctacttacaatgtgacaaatgtctttgtaaggcattatgggagataaaagctgcattaaacctggctgttgtacttacaagtaatttggaaggcaaaatttcaaatacttgaacctaaagtagggtttcttggttttcatttaattgaaatactgttaggaaacaaaaatttttcataaatttttcttgtggatatgtaagtaaattctatatatctagcaatatgatacatctatagttctgtttaaaggtaacaatgtgaggaagcttatgcgaataacttgacagaagaaatctaaagtaaaagcattttcctagtaggctagcttgttctcttatttcatttattgtaacagtttcactttttaataattatgtgaaattaggaaacagatattctagggcattctgtttagggtgatgaacttattcatgaatgttattaaaaccatttaaatatgccatagtttaaatttgtgatccatgctgttcaatctgtgacctaggatagcagcatcaaggagcattgtgtacatgcagaagtgcacagtacctggagtgaaactgcttgtgttcgatttctgataccattcataactggctgtgtgatctcaaaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtgacaagtggcagtctggattgtcaataaataatgttttcaaaatgagtagtgtacagaagatgatgcaagctggcaaaaaattcaaagactctctgttggaacctgctcttgcatcagtggtaatccataaggaggccactgtctttgatcttcctaaatttagtgtttgtggtagttctcaagagagtgactcattacctaactcagctcatgatcgagaccggacccaagacttcccggagagcaatcgtttgaaactccttcagaatgcccagccacctatggtgactaacactgctaggacttgtcctacattctcagcacctgtaggtgagtcagctactgcaaaattccatgtcacaccattgtttggaaatgtcaaaaaggaaaatcacagctctgcaaaagaaaacataggacttaatgtgttcttatctaaccagtcttgttttcctgctgcctgtgaaaatccacagaggaagtctttttatggttctggcaccattgatgcactttccaatccaatactgaataaggcttgtagtaaaacagaagataatggcccaaaggaggatagcagcctgcctacatttaaaactgcaaaagaacaattatgggtagatcagcaaaaaaagtaccaccaacctcagcgtgcatcagggtcttcatatggtggtgtaaaaaagtctctaggagctagtagatcccgagggatacttggaaagtttgttcctcctatacccaagcaagatgggggagagcagaatggaggaatgcaatgtaagccttatggggcaggacctacagaaccagcacatccagttgatgagcgtctgaagaacttggagccaaagatgattgaacttattatgaatgagattatggatcatggacctccagtaaattgggaagatattgcaggagtagaatttgctaaagccaccataaaggaaatagttgtgtggcccatgttgaggccagacatctttactggtttaaggggaccccctaaaggaattttgctctttggtcctcctgggactggtaaaactctaattggcaagtgcattgctagtcagtctggggcaacattctttagcatctctgcttcatccttaacttctaaatgggtaggtgagggggagaaaatggtccgtgcattgtttgctgttgcaaggtgtcagcaaccagctgtgatatttattgacgaaattgattccttgttatctcaacggggagatggtgagcatgaatcttctagaaggataaaaacagaatttttagttcaattagatggagcaacaacatcttctgaagatcgtatcctagtggtgggagcaacaaatcggccacaagaaattgatgaggctgcccggagaagattggtgaaaaggctttatattcccctcccagaagcttcagccaggaaacagatagtaattaatctaatgtccaaagagcagtgttgcctcagtgaagaagaaattgaacagattgtacagcagtctgatgcgttttcaggagcagacatgacacagctttgcagggaggcttctcttggtcctattcgcagtttacaaactgctgacattgctaccataacaccggatcaagttcgacccatagcttacattgattttgaaaatgcttttagaactgtgcgacctagtgtttctccaaaagatttagagctttatgaaaactggaacaaaacttttggttgtggaaagtaagtgggatacttggaatcaaggcatctctgtagtacagtcttctttattttttagcatagaaagttggggatgtgttaattgtatttttaagaatatattctaagttctgtacttcaaataa

SEQ ID NO: 2849 - DNA, 2959 bp, Homo sapiens
tttgaggcccaagggggagcgagccggtgctgctgcaggctgaggctgcggcagaggcggcgaggcgcgggcggtgaggacggacagtcaccgacttagtccagttccctgtgatctcaaaacaattgttgcagcaggctcctggcagtctcaagcagttcatcttcttggtgtactggtttcctattgtgattttatcatggaaaatcaattggctaaatcaactgaagaacgaacatttcagtaccaggattctcttccatcactgcctgttccttcacttgaagaatcattaaaaaaataccttgaatcagtcaccagaacatgctaccagataaggggtcttgatccagatgctaagagagggttcttggatctcacgcgggaaggaattcaagtgaaaccatttgcaaatcaagaagaatataagaaaactgaagaaatagttcaaaaatttcaaagtgggattggagaaaaattgcaccagaaattgcttgaaagagcaaaaggaaaaagaaattggctggaagagtggtggctgaatgttgcctatctggatgttcgtataccatcacaattgaatgtcaactttgcgggtcctgcagctcattttgaacactactggcctccaaaggaagggactcaattagaaagaggaagtataactctttggcataacttgaactactggcagctattaagaaaagaaaaagtgcctgttcataaagttggaaatactcctctagatatgaatcaattccgaatgctattttctacctgcaaggttccaggaattactagagactccattatgaattattttaggactgagagtgaagggcgttccccaaaccacattgtagtgctgtgtcgaggccgagcttttgtctttgatgtaatacatgaaggatgtttggtcaccccgccagagcttctcagacaactgacatatatccacaagaagtgccatagtgaacctgatggacctgggattgcagcattaactagtgaggagcgaactcgatgggctaaggcacgagaatatctgattggtcttgatccagagaacttggctttgttagaaaaaattcagagtagtttactggtatattccatggaggatagcagtccacatgtaacaccagaggattattctgagattattgcagccatccttattggagatccaacagtacgctggggtgacaaatcctataacttgatttccttttctaatggagtatttggctgtaattgtgatcatgctccttttgatgcaatgattatggtgaacatcagttattatgtggatgagaaaatttttcagaatgaaggaagatggaagggttcagagaaggtacgagatataccacttccagaagagctcattttcattgtggatgagaaagttttaaatgacatcaaccaagctaaagcccagtatctcagggaggcatctgatctacagattgcggcttatgcctttacatcttttggcaaaaagctaaccaagaacaagatgcttcacccggatacgtttattcagcttgcacttcagctggcctattacagacttcatggacaccctggttgttgctatgaaacagctatgacaagacatttttatcatggccgtacagagactatgcgatcatgcacagttgaagcagtgaggtggtgccagtccatgcaggatccttctgtcaatcttcgtgagcggcagcaaaagatgttacaagcttttgcaaagcataataaaatgatgaaagattgttcagctggaaaaggatttgatcgtcaccttttaggtctcttactcatagcaaaagaggaaggtcttcctgttccagaactctttacggacccacttttttccaaaagcggaggaggtggaaattttgttctctcaacaagtctggttggctatttacgagtccagggagtggtagttcccatggtacacaatggttatggatttttctaccatatcagagatgacaggtttgttgtggcctgttcagcctggaaatcctgtcccgagactgatgcggaaaagctagttcagctgactttttgtgcttttcatgatatgatacagctgatgaactctactcatctttagagatgaatcatctattaagcacttaccaaaacatatcattaaactgagtgctgggagtgagttggtaatatgagatgggaaggaatgttgacttgctaacattcctttaacaagttaagaaaacttgttaaatgtagaaattagtagaatcatgctctctaaatttattctgccatagaaggtagaaatatttttaagctcctctgatgcagcagcaatgcaaattatgacatagtgaatatagaactatgcagtatttaagcctcaacaatccaaatctacaaactttaacaatgcaagtcttactctaatttttaagtatttttgttggtacttacatgggttataaatcctctctctggacatcaatgtagagtccatctttcaagcactttaatttttttagctgccaaagggtatgaattacattattgtatgctaatttccctgaaatcaatgccttctatgttcaccacagggatacaagcctgttatgtttgatgggaaagaccactacaatctaatggtgatctaaaataacttttttgggctgggtgcagtggctcatgcctataatcttagcactttgggaggccaaggtaggaggattgcttgaagctaggagtttgagaccagcctgggcaacagggtaaggtcctgtctctacaagatcaaaaacttagccgggtatggtggtgcatgtgtgcctgtagtccaagctacttgaaggctgagacaggaggatcggttgagcccaggaggttgtggctgcagtgagctgtgatgtgcccttatgctatagcctgggcaagagcgtgagaccctgtctcaaagaag

SEQ ID NO: 2850 - DNA, 603 bp, Homo sapiens; identical to SEQ ID NO: 2833

SEQ ID NO: 2851 - DNA, 2198 bp, Homo sapiens
gacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctgggtaaatataaggagcaagggcgcacagagccccagcccggcgccaggcggtggagcagttttccggcactggctccgctgacctacgataattatacgacggagacctaacgcaagcgacctgctgccttccttcccactgcttgtcttcagtgtgcccggctgggcaggggtgcggtggtggtggccgatgaggacaggaaagggagatagccagggcgaggtggggcgagggctccttcccccaagcaacaccgcccagccctgctccaggcccctgcactccgcccacccctaccctggctgcacctgagcttgctgcccctggggatgttgcccagtggctgtgcactgctctgtgcacgtgcgtgtgtgtgagtgcacttgtgtgtgggtgactaagtggatgcatgtgtgtgcctgtgtgagtgagggtatgtgcacctaagtgtgtacatgtgtgtatgttgtgaaagtgtctgtgcacatgaatgtttgtgtgtgtgtgaactctttcttactgctggaagtcacagaattcatattgctgcccgggttggtgtggccacctttccctttgtccaagactccacatggaaggcatttgagctcgacctccgaaaagctacccagcaaagagcagtctgtgcctctgagcagaccgtgagaactcaggggacgagtggctaagagcatggcctctcccagaacccacccagggtggtgtggtgggggcaacaggggccagactcctctagagggagggtggctctggggccctggaaaacgtgagagactgccctgagctggtccagtgggccagcactttataccaactcagcatttaagggaagtatcttagattgcctccatctcaatgtgaatgcaccaggctgagggttccctagcgccttgagtcaaggccacttttcagcccatcgagccctgagttctacttggtgtttgttctctggagctgattgcacttgagctctgtggtgggcaggcgcactttagcctaagttgggtgccccagggcaccccctcctctctgctccttgccagcttcattcactcccagcctctcgctgtcctcactttgcaggggctcctcctcaacatttgcatgcacctgcaagaattgggaagaaagagcatttattaggcactgtagcaatttgcattttaaaatgcctgagcatttattaagcttcttggtattcacttgggtttgataattgatctgagctacctcattgaatgtttttggaaaggtgttttttggtatgcaagtcagctttgcctcacagttgaaaatgttcggtcatgattgcttttgaaaccaaaggggaaggtaccgatatcattgagctatttaaagttgccagtttgggctccagtaatgctttctggtgggtaaaattccacattcaggccacgagagcatctacagtttgtactctggggctgcaggcatcctgggacgctgtacgcaattcagtggtctagtcctttataccgactcagattccttaagcatgcagagtcactcgaatgaaaaaacatactcgacctctccctaaaaagatgttgcaacccagtttctctgaattccaccacaaaaagagaccctgaataagaagagcagttttcctgtgcatatagagggtgtgtcaaaggtgagctttttggggaccgggaaaaacaaagttgcctgattccgcgcaggtgcacaggccccggatgtacacccggaaaggggagtgtggctgtagaatcatccatccgtctacagctaaaacaatttgccaataaagtacatgtttttcctaagccaaaaataaatacgttaacagaaaaatgatttaggatatagctt

SEQ ID NO: 2852 - DNA, 738 bp, Homo sapiens
gccgccatcgctgtgagccctgtactatcagccatggtcaactccgtcatcttttttgacatcaccgtcgacggcaagcccttgggccgcatctccatcaaacagtttgcagacaagattccaaagacagcagaaaactttcgtgctctgagcactggagagaaaggatttcgttataagggttcctgctttcacagaattattccagggtttatgtgtcagggtggtgacttcacacaccctaatggcaccggtgacaagtccatctatggggagaaatttgatgatgagaacctcatccgaaagcatacaggttctggcatcttgtccatggcaaatgctggacccaacacaaatggttcccagtttttcatctgcactgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatctttgtgctcttgctgcagttccctttgggttccatgttttccttgttcccttccatgcctagctggattgcagagttaagtttatgattatgaaataaaaactaagtaacaa

SEQ ID NO: 2853 - DNA, 674 bp, Homo sapiens
gaggtggccgccgctggctccctgggccccagcctggttcccgcgcgggccgcggctgccttccagacgcagggcatgcgacctgttggagtgtgaaattctaggggccgggttcctccccagagcggttttatttccgactggactgtgctgcgggtctcagaggccctctggtccgttcaggtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatct

SEQ ID NO: 2854 - DNA, 1272 bp, Homo sapiens
tgcccctctaccatgtggcccttcccgagccgctctctcttcccacccccgactcaggcctggctccagacggtctcctcagaccctgaggcccagggctggggggcctggaacgagaccaaggagattctggggccagagggtggggaagggaaggaggagaaagaggaggaagaggatgcagaggaagaccaggatggggatgcaggctttctgctgtctctgctggagcaagagaacctggctgagtgcccattgcctgaccaggagctggaggccatcaagatgaaggtgtgtgccatggagcaggccgaggggacgccacggcctccaggagtgcagcaacaggccgaggaagaggagggcaccgcggccgggcagctgctgagccctgagaccgtgggctgccccctctctgggacccccgaggagaaggtggaggctgaccacagatccgtctacgtgggcaacgtggactacgggggctccgccgaggagctggaggcccacttcagccgctgtggggaggtccaccgagtcacgatcctgtgtgacaagttctctggacaccccaagggttatgcctacatagagtttgccaccaagggctccgtgcaggccgccgtggagctggaccagagcctcttccggggccgggtcatcaaggtgctgccgaaaagaaccaacttccctgggatcagctccacagaccgcgggggccttcgaggacacccaggctccaggggggcacccttcccccacagcggcctccagggcaggccccggctcagaccacaagggcagaaccgggcccgtggaaaattctcaccatggttttcaccgtattaaagggaagacccgattttgagagaggggctggggcctggatcaggagtaaaccacttgtgctccatcctggggctggggcagggagtggcgcgggggcgaggccagaggagaggggtgtccagagcagccactggccccctcttggcggggggatggcccagtagggccttgtatggtggtccagacccaaggccacagccacgagtcacagccacggcccggtggtgagcctggcatgggccccacggggatctgcggggctctgggtgttgagggaggggaggagcagagtcccaggcagtgccaggccagcttggggttggcatgctcagctcttcaactaagtcattttaagaaaaatagaaacgtgtgtcttaatggtgaagcataaattattaaacttgggctctttttaaaagcaaa

SEQ ID NO: 2855 - DNA, 543 bp, Homo sapiens
acaatatacaaggtagccagaagtgaatatgattgagaattctcattagtgtgaggagacagtttgaagtccataaggttggaaattgcaaattaatcatttgtatataagtcagtttaattcagatctgctttgtgacaaggttaggagagaatgtggggcttaaaggtgatgtcgacaatgaaagccatttcttcttatggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcag

SEQ ID NO: 2856 - DNA, 966 bp, Homo sapiens
agtggtcaaggccgcgctcgcgccgaggggctgcgagagtgaccgcggctgctccagcgctgacgccgagccatggcggacgaggagcttgaggcgctgaggagacagaggctggccgagctgcaggccaaacacggggatcctggtgatgcggcccaacaggaagcaaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtaagcttagacagccttgaggaactttactgttacctgctttatcaaaacatggcttcaaaaggtcagctgcatcttcactggattacagaattcttgctgactctcagaagaaattgttggagagaatagtcatacctactttaaaagagaataaattgcctttcctaaattcctctgcttcgctcctttcctggcgttgctctggaaccttgttggtgtctgtgacccaatgactgttagggtcagctagcttcaattgcccctgcactggaagcaaggtttgtcagtaacaccaattaaaatactaccagtgtaagtagaaggtgtgttttgcagatgagaaggtgctaagatgccttgcttatgttctctgtgttgctgtaataccatgaggggtatgttgtggcaaacctggcctttgagatcaagacgaaccccacctgccctgagaagccgtctgctaccaccacagcctacccgaattggtcctgtcccctaaacccctcacactgagaactgcttgtgtgggagagagctggttgggttgatcttttccgagtgtgacttacctccttcaaggggatgtttaagcttctcgggcagaagtggtgtgtctattcctgacaccaaaca

SEQ ID NO: 2857 - DNA, 6603 bp, Homo sapiens
gccacagggacagccggtgggctcggtggggctgcagaaggtcggggctgcactgctctcggcccccacacggttggttggttggcgtggtaagtgccctgatccctggtcctgagaactcaggctggcacagggattcccagggcatctaccaccacgcagctggagcagggctgagcccaggagcatggagatggacgcccccaggccccccagtcttgctgtccctggagcagcatcgaggcccgggagggctgccatcagcagcagtgagccatcacctctgctggccacattgtgttttttctcctagaactgtggacaacggaaggctgagccccatccattgagttcctggggccccactggaggggctgctgtggccagggtgcacggtcacaaatgaagacaccaaggcgcagagaggtgactcagcctgccctcagtcacctatctgctcctggaggtgatccccgactccatgaggaagcaagaggtgcggacgggcagggaggccggccagggccacggtacgggctccccagccgagcaggtgaaagccctcatggatctgctggctgggaagggcagtcaaggctcccaggccccgcaggccctggataggacaccggatgccccgctggggccctgcagcaatgactcaaggatacagaggcaccgcaaggccctgctgagcaaggtgggaggtggcccggagctgggcggaccctggcacaggctggcctccctcctgctggtggagggcctgacggacctgcagctgagggaacacgacttcacacaggtggaggccacccgcgggggcgggcaccccgccaggaccgtcgccctggaccggctcttcctgcctctctcccgggtgtctgtcccaccccgggtctccatcactatcggggtggccggcatgggcaagaccaccctggtgaggcacttcgtccgcctctgggcccatgggcaggtcggcaaggacttctcgctggtgctgcctctgaccttccgggatctcaacacccacgagaagctgtgtgccgaccgactcatctgctcggtcttcccgcacgtcggggagcccagcctggcggtggcagtcccagccagggccctcctgatcctggacggcttggatgagtgcaggacgcctctggacttctccaacaccgtggcctgcacggacccaaagaaggagatcccggtggaccacctgatcaccaacatcatccgtggcaacctctttccggaagtttccatctggatcacctcccgtcccagtgcatctggccagatcccagggggcctggtggaccggatgacggagatccggggctttaacgaggaggagatcaaggtgtgtttggagcagatgttccccgaggaccaggcccttctgggctggatgctgagccaagtgcaggctgacagggccctgtacctgatgtgcaccgtcccagccttctgcaggctcacggggatggcgctaggccacctgtggcgcagcaggacggggccccaggatgcagagctgtggcccccgaggaccctgtgcgagctctactcatggtactttaggatggccctcagcggggaggggcaggagaagggcaaggcaagccctcgcatcgagcaggtggcccatggtggccgcaagatggtggggacattgggccgtctggccttccatgggctgctcaagaagaaatacgtgttttacgagcaagacatgaaggcgtttggtgtagacctcgctctgctgcagggcgccccgtgcagctgcttcctgcagagagaggagacgttggcatcgtcagtggcctactgcttcacccacctgtccctgcaggagtttgtggcagccgcgtattactatggcgcatccaggagggccatcttcgacctcttcactgagagcggcgtatcctggcccaggctgggcttcctcacgcatttcaggagcgcagcccagcgggccatgcaggcagaggacgggaggctggacgtgttcctgcgcttcctctccggcctcttgtctccgagggtcaatgccctcctggccggctccctgctggcccaaggcgagcaccaggcctaccggacccaggtggctgagctcctgcagggctgcctgcgccccgatgccgcagtctgtgcacgggccatcaacgtgttgcactgcctgcatgagctgcagcacaccgagctggcccgcagcgtggaggaggccatggagagcggggccctggccaggctgactggtcccgcgcaccgcgctgccctggcctacctcctgcaggtgtccgacgcctgtgcccaggaggccaacctgtccctgagcctcagccagggcgtccttcagagcctgctgccccagctgctctactgccggaagctcaggctggacaccaaccagttccaggaccccgtgatggagctgctgggcagcgtgctgagtgggaaggactgtcgcattcagaagatcagcttggcggagaaccagatcagtaacaaaggggccaaagctctggccagatccctcttggtcaacagaagtctgacctctctggacctccgcggtaactccattggaccacaaggggccaaggcgctggcagacgctttgaagatcaaccgcaccctgacctccctgagggtgaaattcatgtaccataaaattgactgttttaggcgggtcccagaggctgatgcctgtaatcccagcactttgggaggccaaggcaggtggatcacttgaggtcgggagttcgagaccagcctggccaacatgcctccagggcaacaccgttagggatgatggtgccaggtccatggctgaggccttggcctccaaccggaccctctccatgctgcacctgcagaagaacagcatcgggcccatgggagcccagcggatggcagatgcccttgaagcagaacaggagtctgaaagagctcatgttctccagtaatagtattggtgatggaggtgccaaggccctggctgaggccctgaaggtgaaccagggcctggagagcctggacctgcagagcaattccatcagtgacgcaggagtggcagcactgatgggggccctctgcaccaaccagaccctcctcagcctcagccttcgagaaaactccatcagtcccgagggagcccaggccatcgctcatgccctctgcgccaacagcaccctgaagaacctggacctgacagccaacctcctccacgaccagggtgcccgggccatcgcagtggcagtgagagaaaaccgcaccctcacctcccttcacctgcagtggaacttcatccaggccggcgctgcccaggccctgggacaagcactacagctcaacaggagcctcaccagcttagatttacaggagaacgccatcggggatgacggagcgtgtgcggtggcccgtgcactgaaggtcaacacagccctcactgctctctatctccaggtggcctcaattggtgcttcaggcgcccaggtgctaggggaagccttggctgtgaacagaaccttggagattctcgacttaagaggaaatgccattggggtggctggagccaaagccctggcaaatgctctgaaggtaaactcaagtctccggagactcaatcttcaagagaattctctggggatggacggggcgatatgcattgccacagcactgtctggaaaccacaggctccagcatatcaatctccagggaaaccacattggggactccggggccaggatgatctcagaggccatcaagacaaatgctcccacgtgcactgttgaaatgtgatcctggtggacggatcaggagaatgggcagatgctcagctggaagcttttgaacagaaaggccgacttctggggggcctgtctgggagctgggaacgctgcttgctcagcacgagagccgggctctgcagggaggaaggagaggtgctgccggaggaggtcgtgagctcctcttctgctgcaggagtggtccaggcagggggtgacgggtactctgttatggcacagagaagggaggggccacccccaagggactaggggccaaaggcctgaaagctgagcagtacaggaggctggttccagctttacaccctgaggacttcatgtgtccccaacctttaaaaatgtttattactgcccctttccactcacctggttaaaaatcatcccatgctctgagatgagctgccacctcaagcccgtgaggagcatccgtttggtaggggtaacagaggggacccttctttatcttctcaagaagaagatttcagggtatcatccttacagacatgaaaaagctatgggaaaattgtgaagataaatgaaagttttaattctaggattctggaaacagagacagtaagagttctccaaggattttgccttttttgtttgtttttgagatggagtctcgctcttgtcgcccaggctggagtgcagtggcacgatctcagctccctgcaacctccgcctcccgggttcatgtgattctcctgcctcagcctccccagtagctgggaatacaggcacccgccaccatgcccggctaatttttgtagttttagtagagacggggtttcatcatgttggccaggctggtctcgaactcctgacctcaggtgatccatcagcctgggcctcccaaagtactgggattacaggcatgagccaccacacctggccccattttttatttattacaaaatcaaagacatgggtgatgcctggcacatgttgtctggagtctggcacactggttatcaatagcacattcagtgtattcagtgatgtcattctttatttatttttgagacagaatctgtcacccaggctggagtgcagtggcatgatctcagctcactgtaggctctacctcatgggttccagtgattctcctgcctcggcctcccaagtagttgggtctacaggcacgcaccaccacacccagctaatttttgtatttttagtagagatggggtttcaccatgttgatcaggctggtctttaactcctgacctcaagtgatccacccacctcagcctcccaaagtgctgggattacaggtgtgagccactgcacctggcagtgatgtcattccttactaggcttccaaagccactgctgtggccacagcttccatggagacaggcaagctgagcctctatgtggcaccaattcctgcagctgtttgtgttggagggaaaaaaatccaaatggacatcaacagctttcatcaactaaataaccacagaaaatatttatgaagactataaagcaatgattacttttgaattggaaaggaatcactattatttgaaatgtttcttcaaaagtgagcatccggacaggaaccatcatggatgctgaggccatggatgaaggcctactcgggaagatgatatccttgcagtctcaaaacggcaccccacaaaggtgatatcctaatttacaaagggaaaaaggtaccttaatctgaaatctggcaaatgcagcctcaacagaagtgacagaattgaacatcgccaataatgggacacacagacatcacatgcccccagtctgatgcaccacggagtcgtctctgatgtattcttgtcaaaaaatgtttgcctgattctaatcatgaaagaacaattagaaaaaatccaaattgacagatattctgcagaataaatggcctgacctcatcaaaaacatcaatgtcatgaaaaacacaaaacattgcagatagcgtgaaattaaagattacagagatataatttaatgcaagatctctgactggatcctagactgcaggaaaaagtctgctataaagaacatttggatcacttgtagtagctgggaaataaaacaaaacattatttgtaaaaggggggaaatctgaacatgggtcttgcagtatttatgacagtttttgcggggcagagatttctagattgacagctgttttagtactttcaaggtgatgctctgtctgctggtttgcattgtttctgtctgagttaagagactggcagaacacagagttgcagtagccaaacactggagaaagctgggccctacagaaacctaacgctgaagaaacctcaggagccaaactggtggagaaaacaaagagtcctccctctctcccttttcaaataatgatcatacatcttcaagctgtctgaaatggttaaggagttcagtctgtcgtcaggcacacaccagagccagctagcccacacagaccccatcagagcaaaacagacaagagaatttaattcatatccacatagaaaggacttctaggtaggaggtagaccctttagctcccttccaattaaaggagtccccaattctggcacctgagagtcccctgggtctaacagctatgatatttatgtagtgtgttgcttacctaaatgaatacaatttccttccagacacgtgacactgatattaaagtgctaatgagagggatctatttcttcttgtacgctaaaagagaaacagcagttcagatttcccatcagaagtccgaggactttgttcttgataactactaccaataaaaattgagtatttg

SEQ ID NO: 2858 - DNA, 554 bp, Homo sapiens
ggccgggattcgcggcccggagctcgggaccggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaagga

SEQ ID NO: 2859 - DNA, 4433 bp, Homo sapiens
gggatgctgaaggtgctgaaatagcaatgacaagagacttggctcagtgttaaataactgccgcgctggcctgacagtctctgagatgacaatagggagaatggagaacgtggaggtcttcaccgctgagggcaaaggaaggggtctgaaggccaccaaggagttctgggctgcagatatcatctttgctgagcgggcttattccgcagtggtttttgacagccttgttaattttgtgtgccacacctgcttcaagaggcaggagaagctccatcgctgtgggcagtgcaagtttgcccattactgcgaccgcacctgccagaaggatgcttggctgaaccacaagaatgaatgttcggccatcaagagatatgggaaggtgcccaatgagaacatcaggctggcggcgcgcatcatgtggcgggtggagagagaaggcaccgggctcacggagggctgcctggtgtccgtggacgacttgcagaaccacgtggagcactttggggaggaggagcagaaggacctgcgggtggacgtggacacattcttgcagtactggccgccgcagagccagcagttcagcatgcagtacatctcgcacatcttcggagtgattaactgcaacggttttactctcagtgatcagagaggcctgcaggccgtgggcgtaggcatcttccccaacctgggcctggtgaaccatgactgttggcccaactgtactgtcatatttaacaatggcaatcatgaggcagtgaaatccatgtttcatacccagatgagaattgagctccgggccctaggcaagatctcagaaggagaggagctgactgtgtcctatattgacttcctcaacgttagtgaagaacgcaagaggcagctgaagaagcagtactactttgactgcacatgtgaacactgccagaaaaaactgaaggatgacctcttcctgggggtgaaagacaaccccaagccctctcaggaagtggtgaaggagatgatacaattctccaaggatacattggaaaagatagacaaggctcgttccgagggtttgtatcatgaggttgtgaaattatgccgggagtgcctggagaagcaggagccagtgtttgctgacaccaacatctacatgctgcggatgctgagcattgtttcggaggtcctttcctacctccaggcctttgaggaggcctcgttctatgccaggaggatggtggacggctatatgaagctctaccaccccaacaatgcccaactgggcatggccgtgatgcgggcagggctgaccaactggcatgctggtaacattgaggtggggcacgggatgatctgcaaagcctatgccattctcctggtgacacacggaccctcccaccccatcactaaggacttagaggccatgcgggtgcagacggagatggagctacgcatgttccgccagaacgaattcatgtactacaagatgcgcgaggctgccctgaacaaccagcccatgcaggtcatggccgagcccagcaatgagccatccccagctctgttccacaagaagcaatgaggactgcccagtggaggaggggcgatgtggctggggagctagggagagactctggaggtggtgggtctctcgggagacccctaatgaggaagttgaggtaatgcttaacattgttgctgtgagaatttactgccctatgtttcccagagccattttggctcaattcaagtctattcaattcaagttaactctagcccagcccagatcaactcctcctacaaatattattggatgataggccctagaacccaataaaggagctccaaatgtcgttgggtggggaagcaaaatgtagagaaacatttaaagcacactgtaataataaatgcaattataaactatatggaggagggtgcagaggagggaatgtgtctggtgtgtgatgtgtgtgtgtgcagtgggggtatcacagagagtatgacatctgagttgagggtagcaggtgcctggagtctcaggtggctgctcacccatctgtgcaggtgtctctggggctgctggtctcacctgtggtctgcagtagacacaattggctgagcaggatatgtgatactgtgtggttggtgtggagttttgaagaaggggctgtgtttgggccacgtaggctctactcagagacctgaaaccacttcagaatggtgcatatgtcgaaagagctggctgggggccttgcccaaaccaactgaggtcttaaagtccagggaaaaaaagtctgggttccaactagaattctagaaatatttctagaacacacagagagggaataagtccctctatcacccttattaccaagccttgtggttccctgtgattttagataatgtctgatatttttctggctatttgcctagtaggatttaaaaaatattttcaaagtgaagctgagagagaatcttggaaacacacatacctgttgatcatgggccctgcagaattggcccttgggggctttatttggttacatgtgcctgggtggtctttaccagcttagactctatcatgggcccccatgaagctccattctcaatactgaataattattacttcccttgttgagtttctttttctgtcatgccctgggggcttctgctcttctcaccagaaagaacatttgaatctggattcttgtacacctgggttagaccctgttcagaggtgtggccaatttatcccgatctcctggaaggctgttgtgatttccatctaagaaatgagggtcttgagaatcaaccagtcccaagattagcctgttatcctgttatctactgagaccccaaatttctcaccaatgttttgggagatcctggaaaagatcccttcagtttggggtgtcaccaagacttctacacaacccaggactaccattgacctcagagctgtaccccacatcttgaagtaaattgatcccaccaggtcccacgtttgttatctctgcctaaatgttagcttctccatcctcaccacatgatgacctgctgtgtccctctgagcactacccagtggctgaaaactctgcaaatgggccacacttttgcaaaatacttgtatctgacacttaggtcttgtttgaagaatttcctttctggaaggttttacaagaagactgatagtctttcaagcccccacatcacaggcttagggacggcactaactttctcccagggatctaactggctagttcaaattatcactcttttaccttcatataaaatgtctcccccaaacctttttcccttctttgtcattgttatctgctaagcccctggtcatttccccatattcgtagtctttttttccatcctatctttctaatatttgttgtctttaacaaactgtgttctgtgtctgtgctcctccttccctctcagaccactggaatgcaagtccttcttccctttggaatgtactctggatcccttcccctgctttgacccccagactttgctccatctattattgcttctccatcctggatccttgacatttgtcaccccactggccttctcaggtgcaatcagtaaaaatgctgagaactcttggatcttaatcttcatgactgagttttttttagttgtatagttatcatctgcctttcttcactttgcatttcttcttgaatccattgcagattgacttccactcccactccttcactaaaagggctcttaccaagatcaaatctaatgggtacattttagttcctatgtgatttggcctttcgatgtcaatcatcactcccagccattgattttggtgacccacttccctgtgatgatcttctgatctagtttctcaggttccttcgctggtcctttttctttccctgcccctgacatattgacatttcctggagttggttttgtccttgattcattctcatgtcattctgcacacagtctctgcatgaactcaggcagacccttcatttaatgaccaccttagggctgatgattctcaaatctgtattccccgatcttgcatttgagctccagccccactcatcctctcggatgttctgcaggcccagcaaactcatcatgtccaaagtgaaactttttctctttcctgtctcctctcctctgatctgttctttcttggaacaccacccaagaacgtcacctcctccatcagattgtgagctcctggagggcaggagctgtgtccttctattcatcttcctatccccagaaccttgcacagatcctggaatgtggtaggtgctcagtaaatgtgtgttgaataaatgaatgaatgaatgaacaaatgaatgaatttgcttacttcaaggcaaaagaaccatgaaactgtattttgagtttctatgttatagcagtcagcaaatcctattaaatactttgtgtttccaagcaaataa

SEQ ID NO: 2860 - DNA, 2079 bp, Homo sapiens
agtatcgcaaaataggccaagtcgctgccctctactcaactcgcagggcgggaggatggagacagagggatgcggcgggagggcgggacagcccagtcgccgccaaggaggcgaagcggggtcggggtagctcacccgccccccgcagtccccgccccccgcagtccccgccccgcgcggcgccgcgcacgcctgaagtcattgcccgaggccccgccccctcgcggccccagccccggctctggctctgccggcggagggggcggagagaacccgcagctgcaacttcgcctggagcctttgagcctgggctcagccggggatctagcagccgtcaccgccgagtcgccgcttccccggcgcgggcctcagcccagccggcttggccatggcaggcgccggcagtgcggcgaatctggcccctgcgctccccgcccgtagctgagcagccgttaaccagccatcccgcctttcctcctgcccgtgtcgccgaggcccacgctccgcgcaagtttccgccgccgaagaagcaggaggacggacgtgaggagtcgggcgtccctggcccacccggccctctcgcccgcgatgtgggggcgcttcctggctccggaggccagcggccgggatagccccggcggagcccgcagcttccctgccggcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaagatcattcaacttcaagtggcacattatcttttaagcctagtcaatcattgattactcttcctactgcccatgtgatgccgtctaattccagcgcttcaatttccaaacttagggaatcattgacaccagatggctcaaaatggagtacaagcctcatgcaaacattgggaaaccacagtaggggggagcaggactcttccctagacatgaaggacttccggccacttcggaaatggtcatctttatccaaactcactgccccggataactgtggccagggtggcactgtatgcagagaagagtcaaggaatggtttggagaagatagggaaggctaaggctttaacatcacaactgaggacaattgggcctagctgtttacatgatagtatggagatgcttaggttagaggacaaggaaataaataaaaaacggtcatcaactctggactgcaagtataaatttgagagctgtagcaaggaggactttagagcctcttcctctactcttaggagacagcctgtagacatgacatatagtgccttacctgaaagcaagcccattatgacaagctcagaggcttttgaacctccaaaatatttaatgcttggtcaacaggcagtaggtggagttcccattcagccttccgtaaggactcagatgtggcttacagagcagctgcggacaaatcctttggaaggtagaaatacagaggattcttacagtttagctccttggcaacagcagcaaattgaagactttcgacaaggaagtgaaacaccaatgcaggttttgactggatcatctcgtcaaagttattcacctggctatcaggatttcagtaagtgggaatcaatgttgaaaataaaagaaggacttctaaggcagaaagaaattgtaatcgatcggcagaagcaacaaattacccacctgcatgagaggataagggataatgaattacgggctcaacatgccatgttaggacattatgtaaattgtgaggattcttatgtggctagtttgcagccacaatatgagaacacttcactccagacaccattttcagaggaatcagtttcccattcccaacaaggggaatttgagcaaaagcttgcatctactgagaaagaagttttacagcttaatgagtttctcaaacaaagactaagcctatttagtgaagagaagaagaaactagaggaaaaagtaggtttttctaataaagttgaattaggtcaacaacatttcctcagcatataa

SEQ ID NO: 2861 - DNA, 1718 bp, Homo sapiens
ccaggaccagggagcaatcacagctgccccgaccttggcttcctctgctgggtgggattgggggctgggcccccaaatgggcccctggcttcccccttcctctgggcaggggacagagagacacaggctcggggagcaggactgacttcctcttgtcccggaatgagcatgcctgccctttgcaagcaggtttgggtctcacgcagaggaaaccaaaagcaataagagggagggaaggcagagcaaccaatcaagggcagggtgagactcaaaacgagcgggctccctggggagccagacagaggctgggggtgatggcggagctacagcagctgcaggagtttgagatccccactggccgggaggctctgaggggcaaccacagtgccctgctgcgggtcgctgactactgcgaggacaactatgtgcaggccacagacaagcggaaggcgctggaggagaccatggccttcactacccaggcactggccagcgtggcctaccaggtgggcaacctggccgggcacactctgcgcatgttggacctgcagggggccgccctgcggcaggtggaagcccgtatggtgaacatgcatatggagaaggtggcccgaagggagatcggcaccttagccactgtccagcggctgccccccggccagaaggtcatcgccccagagaacctaccccctctcacgccctactgcaggagacccctcaactttggctgcctggacgacattggccatgggatcaaggacctcagcacgcagctgtcaagaacaggcaccctgtctcgaaagagcatcaaggcccctgccacacccgcctccgccaccttggggagaccaccccggattcccgagccagtgcacctgccggtggtgcccgacggcagactctccgccgcctcctctgcgttttccctggcctcggccggcagcgccgaaggtgtcggtggggcccccacgcccaaggggcaggcagcacctccagccccacctctccccagctccttggacccacctcctccaccagcagccgtcgaggtgttccagcggcctcccacgctggaggagttgtccccacccccaccggacgaagagctgcccctgccactggacctgcctcctcctccacccctggatggagatgaattggggctgcctccacccccaccaggatttgggcctgatgagcccagctgggtgcctgcctcatacttggagaaagtggtgacactgtacccatacaccagccagaaggacaatgagctctccttctctgagggcactgtcatctgtgtcactcgccgctactccgatggctggtgcgagggcgtcagctcagaggggactggattcttccctgggaactatgtggagcccagctgctgacagcccagggctctctgggcagctgatgtctgcactgagtgggtttcatgagccccaagccaaaaccagctccagtcacagctggactgggtctgcccacctcttgggctgtgagctgtgttctgtccttcctcccatcggagggagaaggggtcctggggagagagaatttatccagaggcctgctgcagatggggaagagctggaaaccaagaagtttgtcaacagaggacccctactccatgcaggacagggtctcctgctgcaagtcccaactttgaataaaacagatgatgtcctgtgactgccccacagagataa

SEQ ID NO: 2862 - DNA, 553 bp, Homo sapiens
agtcggcggccggactgggaagatggacgcagtaaccagtagattctccaagctgcttttccgtgacgagaaagagaaacagtgaatttgtatcatcgggtcttagtttcttggggtcctaagagagagagaaagagaaggactactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggcc

SEQ ID NO: 2863 - DNA, 2820 bp, Homo sapiens
ccgcggagttacgggaaagttggtccgagttcccagagtttccctctgtggtgccctaggctcggccggccggtgccccggctcctttcctcctttcggccttcgccgtccaccaggtccctctctctgtccccggccgccatggagcagccgccggcgcctaagagtaaactaaaaaagctgagtgaagacagtttgactaagcagcctgaagaagtttttgatgtattagagaagcttggagaagggtcttatggaagtgtatttaaagcaatacacaaggaatccggtcaagttgtcgcaattaaacaagtacctgttgaatcagatcttcaggaaataatcaaagaaatttccataatgcagcaatgtgacagcccatatgttgtaaagtactatggcagttattttaagaatacagacctctggattgttatggagtactgtggcgctggctctgtctcagacataattagattacgaaacaagacattaatagaagatgaaattgcaaccattcttaaatctacattgaaaggactagaatatttgcactttatgagaaaaatacacagagatataaaagctggaaatattctcctcaatacagaaggacatgcaaaattggcagattttggagtggctggtcagttaacagatacaatggcaaaacgcaatactgtaataggaactccattttggatggctcctgaggtgattcaagaaataggctataactgtgtggccgacatctggtcccttggcattacttctatagaaatggctgaaggaaaacctccttatgctgatatacatccaatgagggctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgaggaacagcaacgagaattggaagaggaagaagaaaattcggatgaagatgagctggattcccacaccatggtgaagactagtgtggagagtgtgggcaccatgcgggccacaagcacgatgagtgaaggggcccagaccatgattgaacataatagcacgatgttggaatccgacttggggaccatggtgataaacagtgaggatgaggaagaagaagatggaactatgaaaagaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttttgaaaaatctaagtttagaagaactacagatgcggttaaaagcactggaccccatgatggaacgggagatagaagaacttcgtcagagatacactgcgaaaagacagcccattctggatgcgatggatgcaaagaaaagaaggcagcaaaacttttgagtctaatttcctctctgtttttaactattctggagaccaagaaaccactaggaattgaaggaatatttggatatttttaatcctaagattttgccctacaattaggcagaggtcaaaaagtgacaatggtacatgcccaggtaaattcccaaaaggcagaattgacagttgtatctgctgtgcattcactctaagatgaggagaacaaaagaagtgtattctcttgttctgtcagctgcataccagtaataaaactgttatgaaatggattttcaaggtctctaaaccttgaaaatccaaagctattgttgcattgtacagcactgaagggctttatgttacaatattctttattcctatctagtatactaggctatttattgtatccccttaggtaaacttatttatttatgctattttgctttgtttcattttttaaggacaagatcaggatagctttggtgaaggtagggtcatattaatatgatgataatgtgcaaccaatttatactttctgcagggagctatggggtacattccttgatttccaggatagtttttcaaataggaaagcaataatggcagtagttctcaaatgggctaggccttttttatattgaagcaataattccatttttaccctttgaaattttgtttttttgatttttgatgtttggtacaaatagaactatatatatttaggtaaaatagatctatcgtgtttaaaaccaaagaaatcaatggaacccttgcacaaaaaagtgtgataaatatttttaaataaaaacttaatacaaatgtaatttgttaatattgtttcatgttttatgtgtagatctaatagctgaactgattcaaactgtaataagctcatcaatttcatttctatgaaaatgtgctctgttgtcacaggatgtttctgttgattttattcatttcctgggaattggtaaacatcatgttcctgatgataacccagtagcaaaaacatttgtactgagtggtacaagccttggggactgaaaaaaaaaagattaaaaccattaaaaagaaactcatttttacgctgaatgaacatttatatgattgcattgggaccagtcatttcctaagctacatatggccatcttgacagtgttttttcttttgtgtgtttaattattatgtgtaaatcataaagacaaataaatttcactgtgccac

SEQ ID NO: 2864 - DNA, 439 bp, Homo sapiens
gctgggcctggaacagtcggagcagccgctagcagaaggatgacccaagacgggaagcgggctgctgagcctcgccgattcccgtgcttgtaactgccccagccggacaccccccctcccttgacctacccggtctgtgtctcgttccggctcggcctgcgccccccctcgcttcccagccggtttcccctaaggatgggcctgacccgtatcccaagctcttagcgctcaggtcttttccttccgccgacccgaagtcatcgctgggagtactggttgccctttcctcaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagt

SEQ ID NO: 2865 - DNA, 1765 bp, Homo sapiens
aaacaccacagatgcccatcaaaggggcgcacgggtctggaggcgcagctcaggtttttgcgttggtcaccctgccctccgcacgtggagagggcaggcataaagcaccttgaaaggaaggtgctgtcaatgctatccgacgacctgtcgccgggcaccgcagcatcctcgctcgctccgatgggacgagggacgccggccccagggtaacaggaggcgcctcgccggccgcgcgctggatgctgtgatccaggtccggagccgggttccgccgcggccgcagcgacccgaccccacccgacaggccagaggagctcattttgcagctctcaagcttttatagcatgctgtaaacaattgtcaaagttgtttatcaagaaacagatagagttgcaacttgtttctagtaatagaaacttttacactgcattcaatgcctaacgttgcagaaacagaaaggtcaaatgattctggaaatggtgagcacaaatctgagagaaagtcacctgaagagaatctacaaggtgctgtaaaatctttctgcacaagtgcctcaggagcacccttgggtcccaaaggagatggtcattatccatggagttgtccagtgactcatacacgggaaaaaatttatgccatctgttcggactatgcctttctcaaccaggcgacctcaatctataaaactccaaatccatcccgctctccttgcctccctgatagtacctctttatctgctggaaataattcatcaagatacattggtatcccgactagtacatcggaaattatctacaatgaagaaaatagcttggaaaacttatccaacagcctgggcaagctacctctcgcatgggaaattgataaatctgaatttgatggggtgaccacaaattcgaaacacaaatcaggcaatgcaaagaaacaagtttccaagagaaaaacttcagataaaaagggaagatatcagaaggaatgtcctcagcattctcctcttgaagatattaaacagcggaaagtattagacctcagacgatggtactgcataagccgaccacagtataagacttcttgtggcatctcttcattaatttcttgttggaatttcttatacagcacaatgggagctggaaaccttccacctattacccaagaagaagctttacatattctgggctttcaacctccatttgaagatattaggtttggtcctttcacggggaatacaacacttatgaggtggtttagacaaattaatgaccacttccatgtaaaaggatgctcttatgttctatataagcctcatgggaagaataaaacagcaggagaaactgcaggggacctctctcaccacaggaagttgaatattggatcttaattggagaatcaagtagaaaacatcctgccattcactgtaaaaaatgggcagatattgttactgatctaaacactcaaaatccagaatacctggatatccggcacttagagaggggactgcagtatagaaaaacaaagaaggttgggggaaatttgcattgcatcatagcattccagagacttaactggcaaagatttggcctttggaactttccatttggaaccattagacaagaatcacaacctccaacacatgcccagggaattgccaaatctgagagtgaagacaatatttccaagaagcagcatgggcgtctgggccggtctttcagtgctagtttccatcaggactcggcatggaaaaagatgtctagtatccatgagagaa

SEQ ID NO: 2866 - DNA, 1798 bp, Homo sapiens
atcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaac

SEQ ID NO: 2867 - DNA, 394 bp, Homo sapiens
ggaaccatcagttgttcaacaggcacgttacagaggaggaatctgggcccagagaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtgaaaaccacctccaggagctaccaagctaagagcttggtcatca

SEQ ID NO: 2868 - DNA, 2749 bp, Homo sapiens
gcggggcttggggctggatctatgagccgggagcggggatccaggagcgaggagccgggagcggggaacagggagtcggggagccgggaaccagggctggcagcggccgccatgagcacggtggaccttgctcgcgtgggcgcgtgcatcctgaagcatgcggtgaccggggaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggtacaacagcctgagcatcctcccagcagctctggggaagcccgtgcgtgatgtggctgccaaggccaaggctgttggcatccaggggaacttgtctggggacctgctgcagagcggagggctgctggtggtcagcaaaggtggtgataaagtgctcctgcatttcgtccagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttgagcca

SEQ ID NO: 2869 - DNA, 715 bp, Homo sapiens
gctgcgcgcccaggggtcccgcgggttttcgggcgcagggtggcgcccgcggcaggcggcggccatgaacttctccgaggtattcaagctctccagcttactctgcaagttctccccggacggcaagtacctggcttcctgtgtccagtaccggttagtggtccgggatgtgaacacccttcagatccttcagctgtacacgtgcctagaccagatccagcacatcgagtggtcggcagactcgctcttcatcctgtgcgccatgtacaagcgagggctggtgcaggtctggtctttagagcagcccgaatggcactgcaaaatagacgagggctcagccgggctggtggcctcgtgctggagcccggacgggcgccacattctcaacaccacggaattccatctgcggataaccgtctggtccttgtgcacaaaatccgtgtcttacatcaaatacccgaaagcttgtctgcagggaatcaccttcaccagggacggccgctacatggcgctggcagaacggcgcgactgcaaagattacgtgagcatcttcgtctgcagtgattggcagctcctgcggtacaagattctgctgtactcattggatggccggttgttgtccacgtacagcgcttacgagtggtccctgggcatcaagtctgtggcctggagccccagcagtcagttcctggcagttgggagctatgatggaaag

SEQ ID NO: 2870 - DNA, 1456 bp, Homo sapiens
ccggagcggggatcacctcaacttgactgtggtcccccagccctccaagaaatgcccataaaccaaggaggagagggtaaaaaatagaagaatacatggaattggggagaagaatgggaaaaaagatgggagtgactgcataatgtcagcattttgtgcttttggctcagcatttggattggatggaggattttcatcctgaaaccagccctccgtcgccaccgaccatggaataattgtcttccacgaaactcttccctggtgccaaaaagggttttatgtatatatttgagagctccacatccctggatctgaatcctccacttcccactggaaccatgcccctcccagtcccgtttctcccctctaggggatggaggctgagagaccccaggaagaagaggatggtgagcagggcccccctcaggatgaggaaggctggccccctccaaactccaccactcggccttggcgatctgctcctccgtcccctcctcctccagggacccgccacacagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctgga

SEQ ID NO: 2871 - DNA, 1244 bp, Homo sapiens
ggcgagccccgcggggaggccgaggcgcgggtgcgggcgccggcgtagccgcggcggtagcgtcacgcagcgaggccgtgcgtgcgcgggcgtcagggcggcgctgagttgaggacgctggcggctccgcgacgagctttgttttttcggttgggcatgctgcttaccgcaggatgatggaagcgacggcccgtacaaagacagaagcgttggtttcactgagtcagtgctgattctctcaaatagagcttgaaggataaatcttcatttttgtttcaacaaaacttcgaaacaaaatggaagaaaataatctacagtgcagtagtgtggttgacggtaattttgaagaagttcccagggagacggcaattcagtttaaacctccactatacagacagcggtaccagttcgttaaaaatttagtggatcaacatgagcctaagaaggttgcagacctgggatgtggtgatacttcactcttaaggctgctaaaagtcaatccatgcattgaattgcttgttggagtagatattaatgaggataaattacgatggagaggggattcgttagctcctttcctgggggattttctgaaacctcgggatctgaatttgaccatcacattgtatcatggctccgttgtggagagagactctcgtttgcttggatttgacttgataacgtgtattgaattaatagaacatttggattcaggtgatctggccagatttcctgaagtggtatttgggtacctgtctccatccatgattgtcatcagcacaccaaactctgaattcaatcccctgtttccatcagtgaccttaagagattcagatcataaatttgagtggaccagaatggagtttcagacctgggctttatatgtggcaaatcgctatgattactctgtggagtttactggtgtcggggaaccaccagctggagctgagaatgttggatactgtacccagataggaatcttccggaaaaatggaggaaaggcaacagaatcatgtctttcagagcagcatgatcagcatgtttataaagctgtttttaccacctcatacccaagcttacagcaggaaaggttctttaaacttgtgttggttaatgaggtgtcccaacaagtggaaagcttaagagtgagccacctgccaaggcggaaagaacaggctggggaacggggtgataagcccaaagacattggtggctcaaaggcccctgtcccatgctttggacca

SEQ ID NO: 2872 - DNA, 1748 bp, Homo sapiens
gctgggccccaggccagcctctgcctgggaagttctctctgggaacatctggtgggtactacaggccctattccaggccctatggcctgtggaacctcaccacgggggggagggctgggccagacggagacatcacctgtggtgtcagccccatggatgagacagagtggatacacagacatcccaaggctgaggacctaagggttgggctcatcagctgggcaggaacctacctcacctttgaggcatgcaagaatacagtcactgcaactgcgaagagtttgggcaggagacagggcctgcctataagagcttttgcttctgtcttgccatgctggaaggcaacctttggggatggaggtattggctaagtgtgctctctgcggacaacagtgaggaagaaaaaaacctgggagatcttggtgagcaatgagcatgagacacaggccgtggtgcgactaaagagcgtgcagggcctctacctgctgtgtgagtgtgatggcaccgtgtgttatggccgcccaaggaccagccaccatgggtgctttctactgcgtttccaccggaacagcaagtggaccctccagtgcctaatctctggtcgttatttggagtccaatggcaaggacgtgttttgcacttcccacgtcctctcagcttaccacatgtggaccccccgaccagccctccatgtccacgtgatcctctacagccccatccaccgctgctatgcccgggctgaccccactatgggccgcatctgggtggacgcagcagttccctgcctggaggagtgtggcttcctgttgcatttccgagatggatgctaccacctggagacctctacacaccacttcttgtcccatgtagaccggctgttctcccaaccctcatcacagacagcttttcacatgcaagtgcggcctggagggcttgtggcactgtgtgatggagaaggaggcatgttatatccacagggcacgcatctgctcttgggcatgggctgcaaccccatgaggggtgaggagtggttcatcctacagcactgcccaacctgggtcagcctcaggtcaaagactgggcggttcatctcagtcatctacgatggtgaggtgcgtgctgcttctgagcgcttaaaccgaatgtccttgttccagtttgaatgtgacagtgagagccccactgtgcagcttcgttcagccaatggctactacctatcccagaggcgccacagggcagtaatggctgatgggcaccccctggagtctgacacgttcttccgaatgcactggaactgtggcaggatcatcctgcagtcctgcagggggcgcttcctgggcattgcacccaacagcctgctgatggccaatgtcatccttccaggcccaaatgaggaatttgggattttatttgccaatcgctccttccttgtattgcgaggtcgttatggctatgtgggctcctcatcgggccatgacctcatacagtgcaaccaggatcagcccgaccgcattcatctactaccctgccgaccgggtatctaccacttccagggggggatccttctggtcaataacatcctttggcacctttcgcccttggggcaagtttgccctcaacttctgtatcgagcttcaggggagcaacttactcactgtactggcccccaatggcttctacatgcgagccgaccaaagtggcaccctgttggcagacagtgaagacattaccagagagtgtatctggga

SEQ ID NO: 2873 - DNA, 3621 bp, Homo sapiens
accccttccgatatccgcggtggagccgcccttcccaccccgcgtcgctcggcgttagccaaggcccgggcggcgccaccctccgggggcactaggtctggggccgcagtgcccagcacagagcagcgtttatcgggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaagtacttaaaatgaatgctacctggaattaaatgactacatatggcacatctacatcttactttagggacatgaattttttaaaataaataaaatgggaagaaatgtaaatgacatcagatggaaatgtgttttttggggtggcttttagaataaatcccagccttttcaccactttgagagcacagctggcttgaatttaaacctccacgtggacttgctcctctgctctgtcttaaaaaatgtgtaagggaccttgggagggcagtgattcaccacactcgagtttctttacctgatctaatcagatccactcccacaaaatcgatgtgaggagaaatcattgactaatgagtagaatttacttgaatgagaaaattgttacccttgtgcataaagagagagatgtattatctattacttgctaaaagtaagagtcttaggaggaatgtcattacacagcttttaacagttttcttcaagtttgtcctgaaatagggtcacagttaatactgttcagtagaagataggaccctagagcttcaatacagcgttctgtgttttctgtttgaattgaagccttaaaatggtttgataaggattttctatatgcctccactcctacccctccccaggattcttctaaggggtggcttttttttaaattcaaggacgaatattttcaaaaaccctagtgaagaagaaatatttactgattacatttcttttcccttagggataaagaaatggagaagagctttgaagtagtaagacacaaaaatagaggtagggatgaggtttcaaaaaaccaggcccttaaacttcagctagacaaccaatatgctgtgcttgaaaatcagaaaagcagccactcacaatacaattaaggaatgggctttgctaacccttctgaggtaactagactgcagctaaccaccaccaacagccattcatcatctgatctctgctggatctacagacaccgatgcagaccactcgatttcatgaccggccctattgcactatggaagttaaagtgtcacgactgctctatgcatattggatttaggggaattttcattgttacataaatgtgtgaactagtttcaacagtgttctttcatatttactctgcaaatacaaaaaaccaaaacctgcagccagtggtcatttcaaaatctttttatgttcagatactgagccttcataagggttgactacctcagatttgctgcactcattgtggacttcatgtggatcacaacttctggataagaagattacaactattaagtgtcgatgtgaaccttgcaaccagctctactggattcttatcagaaatcctgcataaaaagtcagccatctgggttctgatctgctgtaaaagatgaagatttaagtgaccttaattaacctgtcctgtgccctacccttaaggaatactctctgtagtaggctgttgttatattagacttcctggaacacactgctgaaaagaactgatgtgttcagatcatctgtgtagggctgtgatttgtaatttaaactaattgtattctgaggtaaccacaaaataaattcaaccaaactggggtccaccaagtgggggaaggggaagggagagaataatcttgggggttttttttttttggtaatttttttatttggatagtgcttttttgttttgtttttgttctgcattaaggccttttttgctttgacttgaaataagttctttgacagagcatattgcttggttaattaagtaacctaaagtatgcattaggattgtgaaatgtctcgtgagtatgccaatcctgagggtggaaccaaatagcctttgatgaaaagggcagtggattctggaggctctacttcaggtgctgctataatgcctcatctaatcaggactaaattgtgtaggaaactgcagtgggaagaatatgctttctgctcaggctaagagggtcactgatctgtccttagaaattcagagtaacatgagcaaaacctcagctaaaacccatttaagtggcatggattgtgcatgatctttgataagaattcctcatgtacttgtgcctagtttttcaaggtattggctgttctatagatgcagtgattgtcccagctagctctgttaccagccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcaataaaaagtaaatatatgg

SEQ ID NO: 2874 - DNA, 1435 bp, Homo sapiens
gaactcgagttggaagaggcgagtccggtctcaaaatggagggccatgatccaaaggaaccagagcagttgagaaaactgtttattggtggtctgagctttgaaactacagatgatagtttacgagaacattttgagaaatggggcacactcacagattgtgtggtaatgagagacccccaaacaaaacgttccaggggctttggttttgtgacttattcttgtgttgaagaggtggatgcagcaatgtgtgctcgaccacacaaggttgatgggcgtgtagtggaaccaaagagagctgtttctagagaggattctgtaaagcctggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatgatcatgatacagttgataaaattgttgttcagaaataccacactattaatgggcataattgtgaagtgaaaaaggccctttctaaacaagagatgcagtctgctggatcacagagaggtcgtggaggtggatctggcaattttatgggtcgcggagggaactttggaggtggtggaggtaattttggccgtggtggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaact

SEQ ID NO: 2875 - DNA, 606 bp, Homo sapiens
aacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcagccattctcttgatcccagtgggggctggatgaaggaagagcaaaacaaaccacgaagacagcctggagccgcagccagctctgctgacttctgaacttcacgctctcactgcccagatggccaggggtgtttcctcctctgctggtcttttttaaggcaggatgtttgttgttattgttgttgtttttctggttggttcttaagaaattattttctacatcttgaaaatgccagctggaacctacaccagttgttggtggggtgtgagaactatcctttacatggacttggagcatttgcaactagagcctccacattgaaataaac

SEQ ID NO: 2876 - DNA, 541 bp, Homo sapiens
atagacctgaatgggctcagccctagacacacttttaaagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcaccaggcagctgaaattgaatggctgg

SEQ ID NO: 2877 - DNA, 682 bp, Homo sapiens; identical to SEQ ID NO: 2784

SEQ ID NO: 2878 - DNA, 801 bp, Homo sapiens
aggcgcagtgtggtgagcgagccgaagcgcgggaagcagctcttgtggatcctcagtggcggaggctcggtcacccggttttattgtgacttgtggaagtgatggtgatgtgaggatttgggaagacttggatgatgatgatcctaagttcattaatgttggagaaaaggcatattcatgtgctttgaagagtggaaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgatggatagcagccaacagaaaacatttcgaggacatgatgcccctgttttaagtctttcctttgatcctaaggacatctttctggcatcagctagttgtgatggatctgtcagagtgtggcaaatttcagatcagacatgtgctattagttggccactgctacaaaaatgcaacgatgtgataaatgcaaaatcaatctgcagacttgcttggcagccaaaaagtgggaagttactggcaattcctgtggaaaaatctgttaagctatatagaagagaatcttggagtcatcaatttgatctttcagataatttcatctctcagaccctcaatatagtaacctggtctccctgtgggcaatatttagctgcaggtagtattaatggtctaatcatagtttggaatgtggaaaccaaagactgcatggaaag

SEQ ID NO: 2879 - DNA, 2682 bp, Homo sapiens
cccgctcctcccccgacaaggcgatgaggtaatcgcgccgctgagaggcacgcgcagccggtgcctagccggttggtccctgcgcccctgccccgccggccaccgcccccccacaccgtcccggccccggcagcctggccccaccatgaccgagcggtgcagcctgtggagtgccctgtcggccgccgcctgctgcttctaccgcggctccttcgtgcaggtgcagttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcactcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccaccagtacgtcgctgccccgccctcgggactccatccgcagctgtgccctcagcatggaccagatcccagacctgcactcacccatgtcgcccatctccgagagccctagctcccctgcctacagcactgtaacccgtgtccatgccgcccctgcagccccttctgccacagcattgcctgcctcccctgtcgcccgccgttccagtgagccccagctgtgtcccggaagtgccccaaagacccatggggagtcagacaagggcccccacaccagcccctcccacacccttggcaaggcctccccgtcaccatcactcagcagctacagtgacccggactctggccactactgccagctccagcctcccgtgcgtggcagccgagagtgggcagcgactgagacctccagccagcaggccaggagctatggggagaggctaaaggaactgtcagaaaatggggcccctgaaggggactggggcaagaccttcacagtccccatcgtggaagtcacttcttccttcaacccggccaccttccagtcactactgatccccagggataaccggccactggaggtgggccttctgcgcaaggtcaaggagctgctggcagaagtggatgcccggacgctggcccggcatgtcaccaaggtggactgcctggttgctaggatactgggcgttaccaaggagatgcagaccctaatgggagtccgctggggcatggaactgctcaccctcccccatggccggcagctacgcctagacctgctggaaaggttccacaccatgtccatcatgctggccgtggacatcctgggctgcaccggctctgcggaggagcgggcagcgctgctgcacaagaccattcagctggcggccgagctgcgggggactatgggcaacatgttcagcttcgcggcggtcatgggtgccctggacatggcccagatttctcggctggagcagacatgggtgaccctgcggcagcgacacacagagggtgccatcctgtacgagaagaagctcaagccttttctcaagagcctcaacgagggcaaagaaggcccgccgctgagcaacaccacgtttcctcatgtgctgcccctcatcaccctgctggagtgtgactcggccccaccagagggccctgagccctggggcagcacggagcacggcgtggaggtggtgctggctcacctggaggccgcccgcacagtggcacaccacggaggcctgtaccacaccaatgctgaagtcaagctgcaggggttccaggcccggccggagctcctggaggtgttcagcacggagttccagatgcgccttctctggggcagtcagggtgccagcagcagccaggcccggcgctatgagaagttcgacaaggtcctcactgccctgtcccacaagctggaacctgctgtccgctccagcgagctgtgaccccagggacatttcccctctgcagctgcggacagcgtcaggggcagaggggcacacaactttccccagagcaccccaaggacactgtgatcaacccgagaatgttctgggttcaactcaagcatctcccttgcacctccagggtcctgcgtggactctgggttccatcccacctgctacatgctcaccaggtctccattgaggaagaacaggaacgccggttcccccaccagcttttgctgctccccttcctgctggggttccctgttttcgagccatgggaggcaggctgctcacgcctcctcactctctgtctgtccctcaccaacaccaaggcctccatctcactgtaaataagtctctgttctgtaaatagatgtacagaagccatgttatttctttcatataataaacttttatgactcttt

SEQ ID NO: 2880 - DNA, 790 bp, Homo sapiens
tgctttttgggaaatgcatcagatcttttctgttcttgaaacgccaaatctaacttggtctttttttggatgaattaccgccagtattatgaaggttactgtgaaggaacttgagaccactgaactttttgagttcttgcgactcacttttccccttcgtctttctctccctttctgtctttctgtgtctcctccaagaatgaaatatgactgaggactctcagagaaactttcgttcagtatattatgagaaagtggggtttcgtggagttgaagaaaagaaatcattagaaattctcctaaaagatgaccgtctgggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagag

SEQ ID NO: 2881 - DNA, 5454 bp, Homo sapiens
tcacagccaggtaaccctggagtgaagcggtttagttagaagggagcagataaactcgtcactctagtagctttaaccctcaccctgaggcaccttagcaatcagccattgcctgcaagcctccaaagcttgtctttgcctaatatggagcccaaagaagccactgggaaagaaaacatggtcaccaagaaaaagaatctggccttcttgaggtctagactctatatgctggagagaaggaagactgacactgtggttgagagcagtgtttctggggaccactctggcaccttgaggaggagccaatctgacaggactgaatacaaccagaaattacaagaaaagatgactccacagggtgagtgttctgtagctgagaccttaaccccagaggaagagcatcatatgaagaggatgatggcaaagcgggaaaagatcattaaggagctgatacagacagaaaaggattatctcaatgatctagagctgtgtgttagggaagtggttcagcccctgagaaataaaaagactgataggctggatgtggatagcttgtttagcaacattgagtccgtgcatcagatatcagccaagctgctgtcattgttggaagaggccacaacagacgtggaaccggccatgcaagtaattggagaagtattcttgcagattaaagggccactggaagatatttataaaatctactgctatcaccatgatgaagcacatagtatactggagtcctatgaaaaggaagaagagctgaaggaacatttgagccactgtatccagtccttaaagaaaatatacatgcaagaaggcaaaccaaacttattggacatgggctctttgatgatcaaaccaattcaacgtgtgatgaaataccccctattactgtgcgaacttcggaattccacccctccctctcacccagattacagagcactggacgatgcctttgctgctgtgaaggacattaatgttaacatcaatgaacttaaaagaaggaaagatttagttctaaaatacaagaagaatgacgaggatgaatcacttaaagacaaattgtctaaactaaatattcattcaattagcaagaaatcaaaaagagtgacaaatcatctgaagattctgaccagaggagaatcacaggttaaagacaatacctttaacagagaagaaaagctgtttagagctttagaaaagactgtgaggctttgtgtgaagaacatttcactctgtcttcaacacatacaggatgccatgcccctggctctgcagagtgtgatggaccttcaggagatttcatacaacaaagacgatgagatggactattctgagaccctaagtaatgccttaaattcgtgtcatgactttgcatctcacttacagagactcatcctgacccccttgtcagccctgctgtccttattcccagggcctcacaagctcatccagaaacgctatgacaaactgctggattgcaacagctacctgcagcgatcaacgggagaggagtcagacttggccaaaaaggagtatgaggccctcaacgcccagcttgtggaggagctccaggcattcaaccaggctgctcggaagattctgttgaactgtctatgcagcttcattaccctccttagggacctgatgctcgtggcacagcaggcttactccacacttgtgccgatgccactgttggtttcaagcatttctgagattcagaatcaagtactagaagagatccaaaatttgaattgtgtgaaagaaaacagtgccacctttattgagaggaaactcagttttgaaaagaagaaacctgtgcagattctgccagaaatgccacatcaaactgacattcatcgctccaaacttctatccacatatagtgcagaggaactctatcaagctaagcgcaagtgcaatgctacacaagaatatgacatcaatcttctggaaggagacttggtggctgtgatagaacagaaagatccactggggagtacaagcaggtggcttgtggacacaggaaatgtgaaaggatatgtttattcctccttcctaaaaccctacaatccagcaaaaatgcagaaagtggatgctgagaacaggttctgtgacgatgattttgagaacatcagcctcttcgtgtcttcacggccagctagtgacagtgtcacaggcacctcagaaagcagcattggtgatagcagctcatctcttagtggcacatgtggaaagtttgaaacaaatggtactgatgttgacagttttcaagaagtagacgaacagattttctatgcagttcatgcttttcaagcacggagtgaccatgaactcagccttcaggaataccagagagttcatatactcaggttttgtgacctaagtggcaataaagagtggtggttagctgaagctcaagggcagaaaggatacgtgccagctaactaccttggaaagatgacttatgcttaagaaaataagccttcaacttttattttccagcaagttgttgattgactacctcataaaactgacattacaaaactttggaccagaaagcaagaaacctctgaactacagaaactgatactgtactgggttttcaggaatactgtacttcctaacaggattattgcatgaatgtattataaaggatacatgttgaaagaaatactaagccaacagaaatagcaaagcaaatgacccaagcttcaactatcaactatttaaaagtgaagatcttttgaaggagtaattatattcttttatcatcaagaaaggttggatccaaaggtttttcaatttacttttttttttactgtatgatgtattttgccttaaatgtttttgtttttcatattgctctcttgcaaatgcatacatgtttatatacatacatataaaccatatatattatgtagctttatacacgtatgtggataatatgaattatacacctatatgtataaatcagagtatacaccaaatatacataagaagaatataccaccaactagaagtctttgataatatattttgttaatgtttcgtttatatgttttgaactaaaactgaataacttgatattaacatgtaacattactgaatgcacactatatgccagacattgttctaagtgctttatatgtagtaacttgtttaatattcaaaacattatgaagaaaccatggcccaaaaaggtgaagtaatttaatccaaatcacattgctattaagtggtgggcctggacttaaacctaggtagtgtaaaccaaaaataaaattctaaggcttccaaccatctaaatagacttccccttcagccagggcttttttctttcttttcttgttgtttttttttttttttaaagagacaataaaaggaggtttttttattcaaaggtataactggataagtagatttgtttacaatcattcttgtgaaatacttttttaaaaaaatacgatcaacttctttgcaaatagtagacacatacctcaacaatgatgacctaatttttgatccataatgtaagattaggtagaaataggcaagctcacactgctaaattaactatcaaatactcagtcaaaactccatttgtggcccccacttcttgatctatttctgttccacttcgtcttctaccatcttgccgactttcctgagcaactgctttgtcgactctctctacctgaccaattgccagatcgacaacctgactggcctgaccagccactcctctgtctggaattaaaagatgtttccatcataatattctttaatttcaggtaatttagctggcactgagagtatccagccggaatcatgccactttgcctgtaacctttgactcaattggaggaatatcaaagcaaacacccatatttcctttcaggaggcacactctggtaatctgagacactgcattactattcagctttctaagttctttccaagcacagctgacatcctgtatttcctctaggctttccagagtcatggtcacaaaccccttatcagagttgattaaagatcatggttcaaagcttgatacaccagaaatgtgggctaaagctgcagccaatgcatctatcgcccctttctcttctatcagtatctgagctgatggttggaaaaaaatcaacagcagcataagaaatggaagccagagaccttatggcatccatgcttttaaatttaactaaatccattgtagaaggaacacctacacatttaaaagtaatttgtgttttttgttccacatgtcttagttgacctttctcttggttgataaaaacatatacaaacccctgtctgtccagctttacccacgcatccagagagatggatataggactcaatatcctgaggaggagaactttgaatcaccaggtcaactacaggaatgtccaaaccacgaggagccacattggttgccaccaaaactttataattacctctctgaagccttttagtgtaatttctctttgtgactgtgcaatgtccccatgtaaacacagtgcattctgttttgtgcggattcatggccatgtcagttacattcttcttcgtctcacagaaaataatagccctcccttcagatccactgtagacttgaaggacatctcattttcatctgtgttttataaaggaggaaattgaggacctcacatggagggactggaatttaaaaccaggtcttctgactttaaggcctttcttttagtgttttcccttttcttttccttaagtcactaaaatctgtagttatataatcttacataaagcatatgcaaaatagaaaaatgatagtcaccacatatctactaatgggattaaaatgtacaatcctaaaagcttacttgttagcacacttgcttatctgtccattcattcattgaaccagtaagtatttattgagagttagtgggaatacaatgctgtgcaagacaaacaagatccctccattcataccacttaaattctagtggggaaaacatctgcacataacaaactaaataaaatgatcataaaataataaatgctatttatataaaactggctactttcattactgctcagttaaagggtcttgtagctcattttatgacatgaaaaaaatcaaggtctaaaagctccttgagacaatttaaactctaataccaaatatacctctataaaataccaaactgagctaaatacggtatatgtgtacttatacatatgtacataacctaaatatacgtgtgcacacattatctatacaaagagccatactcagtgaaagataaattacctcctaaactaaagtcccctctgaggtacaacagaaattaaaataattgcttctcttctcaactctatgtagcacgtattttccatgatgggataaatgttttcatttcaagtgccaatgtgtgaactgtaataaacattactgctttc

SEQ ID NO: 2882 - DNA, 538 bp, Homo sapiens
cttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactagtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatc

SEQ ID NO: 2883 - DNA, 795 bp, Homo sapiens
gtttaacagctggcccggaagtttaagtgaatatgcggcttgggctccaaaagttgctgtacggtattttattttaaagtagaaatctgtccgcttttcacttacggaggccttacagtgtgtgttctgtgttacttgagtttatacgcactgcagaatttgtttaccctgctcttttggaaacgtattccggaagcgaaaccctgagtaatcggaagtggttaggagtgagagagctgctggatatgcggagggactgggcgggtcggcttccgaatggaagaggtctgtgagaagttaacctggtgataccgatccgaagagcctatcaagtgaagccccctgaaatacggagaataagaatcttagagcagaagtcttggagtgcattttcagtggttaaggtgaaaaaatgactactaaaaatttagaaaccaaagtcaccgttacttcatccccaatccgaggagcaggagatggaatggaaactgaggaaccacctaaatctgttgaagttacctccggagtccaatctagaaagcatcatagtcttcagagtccatggaagaaagcagttccatcagagagcccaggagttcttcagctagggaaaatgctcactgaaaaagcaatggaagttaaagctgtaagaatattagttcccaaagctgctataactcatgatatccccaacaaaaatacaaaggttaagtctctgggacatcataaaggagaattccttggtcagtcagagggagttatagaacctaataaggaactctcagaggtaaagaa

SEQ ID NO: 2884 - DNA, 4086 bp, Homo sapiens
atcactcctagctgctcagcaaaccactgaggttcctgggaaaaaaaaaaaaatatctcaagggtgtgttaacttgggacactcgttaactgggggaccttcttgaggcttttttccttctttttaaaaatcatctttgattattcttcttttctagtaaaataatatttagaaaaaataatgtcagagcacagcagaaattcagatcaagaagaacttctcgatgaggagattaatgaagatgaaatcttggccaacttgtctgctgaagaactgaaagaactgcagtcggaaatggaagtcatggcccctgaccccagccttcccgtgggaatgattcagaaagatcaaactgacaagccaccgacaggaaacttcaatcataaatctcttgttgattatatgtattgggaaaaggcatccaggcgcatgctggaagaggaacgagttcctgtcacctttgtgaaatccgaggaaaagactcaagaagagcatgaagaaatagaaaaacgtaataaaaatatggcccagtatttaaaagaaaagctcaataatgaaatagttgcaaataaaagagaatcaaagggcagcagcaatatccaagaaacagatgaagaagatgaagaagaagaagatgatgatgatgacgacgaaggagaagatgatggtgaagagagtgaagaaacgaacagagaagaggaaggcaaagcaaaggaacaaattagaaattgtgagaacaactgccagcaggtaactgacaaagcattcaaagaacagagagacagaccagaggcccaagaacaaagtgagaaaaaaatatcgaaattagatcctaagaagttagctctagacaccagctttttgaaggtaagtacaaggccttcaggaaaccagacagacctggatgggagcttgaggagagttaggaaaaatgatcctgacatgaaggaactcaacctgaacaacattgaaaacatccccaaagaaatgttactggactttgtcaatgcaatgaagaaaaacaagcacatcaaaacattcagtttagccaatgtgggtgcagatgagaatgtagcatttgccttggctaacatgttgcgtgaaaatagaagcatcaccactctcaacatcgagtccaatttcatcacaggtaaagggattgtggccatcatgaggtgtctccagtttaatgagacgctaactgagcttcggtttcacaatcagaggcacatgttgggtcaccatgctgaaatggaaatagccaggcttttgaaggcaaacaacactctcctgaagatgggctaccattttgagcttccgggtcccagaatggtggtcactaatctgctcaccaggaatcaggataaacaaaggcagaaacgacaggaagagcaaaaacagcagcaactcaaggaacagaagaagctgatagccatgttagagaatgggttggggctgccccctgggatgtgggagctgttgggaggacccaagccagattccagaatgcaggaattcttccagccaccgccacctcggcctcccaacccccaaaatgtcccctttagtcaacgcagtgaaatgatgaaaaagccatcgcaggccccgaagtacaggacagaccctgactccttccgggtggtgaagctgaagagaatccagcgcaaatctcggatgccggaagccagagaaccacccgagaaaaccaacctcaaagatgtcatcaaaacgctcaagccagtgccgagaaacaggccacccccattggtggaaatcactcccagagatcagctgctaaacgacattcgtcacagcagtgtcgcctatcttaaacctgtgcaactgccaaaagaactggcgtaagaggcaacagagccatctagaagaacaagaaatggaaatagtgactcttggattacagcatggagactatgtcagcagcaatactttaggatccacgtggcagaactggaaacaatgctaccatctgataagggtatttgtaaaaggcagaatgtttgggccatgaagaagtaggggctgaagaggaaggtggaaggagataaaatataatatttagaggcaatattttctacttgcaatcaatttgagtgactcaggtgaaatttagagtcatatttcccgaagcagaagttaaagaaaattttttaaacatttgctttattattgttttcttctggtaaataataaatataacagaagtgttaactattgtattcccatttttttctccttccatctcttctgcggtaattcatcacatagtatcttaaagggaacaaataatgtttcatcctatggaaatgtgaaggatgaattgagctcctggcccttctgatgctttgaaatggaaggattgttccttagagcttctctgcagaatcagtggagattttcagtttcccaccctgcctggctttctctcttggtgactcccttggtgttttggagtattctttctataggggtacctgtgaggggcagaacacgtaagccacagaacatggtgaaaactaagtgtcactaggaaaagtaatgggaaagtaaaccctgcatatatgaaaacttcctggcagcaagttttcatatatagagggacaatgggagacagcatgctgtttttatagaaaagaagttttacataatatagttattgacaagcttttggttttggctaaatacacacacacacacacacgctcatatgtgtttactctgtaagtctaatttgattttatcactctcaaacatattttaaaggaaacttgcttacaggaaggattaaacttgaactacttatcctattctttaaggcactccattgcctggccccaatttactaatcctgtcttatttcccacaaatcctttatactctactcgatgaaacatccttgtgcacacccttgtgcctttgctcgcattaatccttccaagagacttccctcctgttctccattaatgaacgtcctacccagtcttcaactcccgggtcagatcctgtgtcctccataaaaaattttccagacaactccaatctgtccttcttccaagttcctagaggccttaattattcattctagccactaggtgcatagaatttgagatttttgtaataatagaagtagtgtgaaccctagaaattagaaaatcaagctttgggccaggtgcggtggctcatgcctgtaatcccagcactatgggaggccagggagggaggatctccagaggtcaggagttcgagaccagcctggccaacatggtgaaaccccgtctctattaaaaatacaaaaattagctgggcatgatggcaggcacctgtaatcccagctactcgggaggctgaggcaggagaattgcttgaactggggaggcagaggttgcagtgagacaagatcacgtcactgtactccagcctgggtgacagagtgatactccatctcaaaaaaaaaaaaaaaaaaaaaaaaaaaaaaaaaaaaaaaaacctttggtgccttttctctcttctttacctgagtaaataattggcacctgccttctttctccttttatgttatcataagtggcatgtatcaaaccaaacaggctaggggagaataggtctaattgtgacagacttaaaaacaacacattatttggaaagacaagccatgggaaagaaatatggcgtttctatttttttaagataatttagtatgtacaaaagtatccaaatttaaatatagttttcaatggctgatagttttgttttctcacccttcaatatttctagaaaacatccttgcatacaaagcaggatagctaagaaagggctgtaacaaacaaaacttcaagtgtctagcacatactacatctaagaggctaaactctgataggaaaagcactttaaacataattaaaagcttaatgtaaattagtagttgaaattctaggccggtgcggtggctcatgcctgtaatcccagcactgtaggcggccgaggtgggtgaatcacatgaggtcaggagttcaagaccagcctgaccaacatggtgaaaccccatttctactaaaaaaaaaaaaaaaa

SEQ ID NO: 2885 - DNA, 134 bp, Homo sapiens
ctggagtgctgctttcctccgaattagcaaatctggtttgccaacacagtatctgccttccaggggattccttaccccatcaccatgtgcacctcagaaactttccaagcgctggacaccttcgaagccagaca

SEQ ID NO: 2886 - DNA, 903 bp, Homo sapiens
gtgctcccccgccccgcgtagcggcggtcgccgccaccggcgcctccacctctaccatctcctctttctccaccacctcgggccccggtgtccccggccagcactatgcccatcttactgttcctgatagacacgtctgcctctatgaaccagcgcagccatctgggcaccacctacctggacacggccaaaggcgcggtagagaccttcatgaagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgaggccgttcatattctgtgtgttctccaagaatgcttaatcagtgtctggagtccttggtgcagaaagtacaaagtggggtggtaataaactttgaaaaagcaggaccagatccttcccctgtagaagatgggcagccagatatatcaaggccttttggatctcagccttggcatagctgtcacaaactcatatatgtcagaccaaatcctaaaactggggttcctataggtcattggcctgttccagagtctttttggccagatcaaaattcgccaacactaccacctcgtacatctcatcctgtagtgaagttttcctgtacagactgtgaaccaatggttattgataaacttccttttgacaaatatg

SEQ ID NO: 2887 - DNA, 507 bp, Homo sapiens
aggaaaactgcagacagaaaaatgtggccggatgctctgtgggcgggcggcagcgatgttcggccaggtggctccaaggagaggaagcagtgatgcattgagggagtaaacatggaatcggtgagaatcactttccttgatcattatgtggtcagtatgcggtgactgacttgatgtgactggggaaggtcccttccctggacagaatatggtgagtgtcgtgccattaccggagaggatcaccttccctggccacatgtggtaaaaataagtgactaaagaagcagacctgggaatcacctaacatgtcgaggaggagatttgattgccgaagtatttcaggcctactaactacaactcctcaaattccaataaaaatggaaaactttaataatttctatatacttacatctaaagagctagggagaggaaaatttgctgtggttagacaatgtatatcaaaatctactggccaagaatatgctgcaaaatttctaaaaaagagaa

SEQ ID NO: 2888 - DNA, 4288 bp, Homo sapiens
ggccatttttcttcctggtgtttgaatgactcataaaatgagtttggagtggtctgaagcctctgcctccttccttgaatgctttctaagaggggctgccatgcaagaatatatgctgattttcccatacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagaatagtccttatcagtggcagaagatccttctgtagtatattttcagtgctgccgtatcgcgacagtacccaagtcggggacttgaagttggacggaggaagacaatcaactggtgcagtgagtttgaaagagatcattggtctggaaggtgtggagctgggtgctgatgggaagactgtttcctatacccaatttctgttacccacaaatgcctttggagcccggagaaataccatagactccacctcctctttctcccagttccgtaacctgagccaccgcagcctctccataggccgggcaagcggcacccaggggagcctcgacacaggtagtgacctgggagactttatggactatgacccaaatctcttggatgacccccagtggccttgtggcaaacacaaacgcgttctgatcttcccttcctacatgacaacagtgattgactacgtgaagccctcggatctcaagaaggacatgaacgagaccttcaaggagaagtttcctcacattaagctgacactcagcaaaattaggagtctgaaacgagagatgcggaagcttgcgcaggaggactgtggccttgaggagcccacggtggccatggccttcgtctactttgaaaagctcgccctcaaggggaaactcaacaaacagaaccggaagctgtgtgctggggcatgtgtgctgttagcagccaaaattggaagtgacctcaaaaaacacgaagtcaagcatttaattgacaaactggaagagaagttccggctgaacaggcgagaactgattgcctttgaattcccggtgttagtggccttggaattcgccctccacttgcccgagcacgaagtcatgccccactacagacggctggtccagagttcctagcactggccccgaggacagccaagggccatttcttctcagcttggtggagcagcacttacttactactggaaatgaaaaaaagtagaactcagaataccagacttttcttcctctcgacatagtttggggagaagcagtactagaaactttccaaggagtcttgggtgtgtagccaagaggagccatgagctatggactcctcaagcacgggaagaggaggtgtgtgctgagaacagagaggccctgccctctgtccactagcgagaatccctagctgccccagcccagtctttctccccggcattcacaaactttgcaagcgtggtccagggccttctccagatctgttccaacttggagtgtgaagggcttgagcatacgggggaagagagtctgcagaagttgggggaaaacttttaaaagataccctcattgtgtcaaagagtgtgccaatctatttttgtatcagcattggaagtgcactttcccctggggcgtgtgggtgtgtgaatgtgcaagtgtctgagagatactgcatcagccctagacccccagagccagtcccgccctttacagagcagcccttagcctggggccatgggtcaggctgaccttcaacaattatttctagatgatttctggataagaattgctctctcggtaccagacagtttgacatcctccacccttagaaaatgactgacattgttttgttactgctcctacccaccaaggggataaagaaggcgagttctgagtgttggatgagtcagtcgcgtggaaggacgtggagcgtggcgctctgtaacttcctgccgtctgccaccccgccacgtgtatttaaccctcgcactttctccactgtggagatggctggggcggcgccccacagtgtgtattcctgtcctctatgttagagtgcatcagaagcacatttactgtgctatctatatcgctatataaaagtgttttataaaaacccagaataggagcacgacgcatgattggtgtttgaggcgtttgccagctgggacaaactgcgtttggagctgtggttaagctgactaaggaggcggtggctctttcttaacattcccacgtgcccagggctgttcatgcaagattttaatggtgacttgtcctggcttactgggacagtctgtatgaggcatgtcaccacactgtcgcctcatagctgcaagagagaggcaccagctgaagttcccctgactgaagagagcctgtggccatgtaaaaagagaattaaactcttgttgctttttgtatacctgtatgcgtttgtgtagacgtgtgtctcaccagtcacctttgccctgcattgctgatccccttgcgcacactgattctagtgaggtcacagattcggagcttcacacaccagcccagagaaagggcgatggaaccgaaccgagggtctgcagctttcgttagcagagctgtcagattcttgacagtcttggaggatggagaaattcaagcagcagctggtgagggccaaaacagaatacttggcttcttcagaatcttagattgcactgagtttagtcctaaatattttgctaacaaatttccttggccagaatcagttgtaagacagtgatttgggtggtggggggagggaggagggagaggatatgattaatgtggtctctttggctgatcgaaagctagatcaactggtacttagggcacttgctgtttataaagcaaaattgagaaaatattcaaggtgcctccatcgcctgaactacaaaatgcccttggccttcctcacatggggtctgtcaccttgcatctctgataagccatccaccttcctggtcagtgcctacagggggagagcctttctgagaagcaggtcctgtggtatctgagaatggtctagagagctccccactgcccatctgcccccgaatttcctgccaagctctggggagtggggtggggggagggacgtccgatggatgacaggccgccagcccagacgtggggagagaagcctgagtcctttcctgtgtgataaaatcaggctaatttacttggatttggggtgatttgtttggtttttagcatttatgaggtgagcccatgaagttagtggtccattactttttaaagatgcattttcattttaaactgtctcctggcctgtggatttgtggaatggacagttttgtgggttttaatttatttgtgaggagtcggggctgagaaggcattttatcaggaggtctccttttgcacgtccatgacatgagcttttcggaggcaaaggaagtggaggagggtgagagatgcaggtcactgccagaggcacctctgtgacacggaacattccagacacgtcgcagccttgggcttcggcgaggaggaagtctgagcctgtgaagcgagaaggccaggcagtagactggctctgaggttttgccctttgacctcctccacagagggcagcttcagccccttgtaagccctgccccctctcaggactgccctgaggcctctccagtcctccccacactcagagatctgtggggaagctccgcccagccacactccttgggataatactagccggttctgcctgattccttttcccccggagccagcctagggggcccgggactcctctagtgagccttgactgttaggtaagagacaggaagcagacaagccaagaggttgctgcagctgcccccaggaggaaacgggcagcagggagtgtggcccagcccccactgtacccctccaggggcccgagcccttgccagcccaatgacaccttgaagtcaccacttttcctttcttgcccgctaataaaacctatttaaacaggaaattcataccaaatgcaaatgggttttgttttccttggcattttgttgttccgatcacagatttccctgccagggtgtctgtggttatcagctgcaggctcagcttggggcggccgcttcacacaagccactctgtaccacgtgccctaccttagtgacgggagtaaggagcttccttcccctccatgtcattccttcctgttcccttcattccccaacagcaaataaaactgttgaatgctctg

SEQ ID NO: 2889 - DNA, 1246 bp, Homo sapiens
aatctctgtctggatacttttaggaaaagaaccttgttattatgtactaaagtgaataatttgtgctcttagagtaggagttggaactataggacttgaaggcaagagcaggtatcttatcaaggatctactcactcagtttccctaaagctctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcaccaggcagctgaaattgaatggctgggatttcgaaaacctagccaagctgacatgttacattctaaacatgatgaggagcagaaggtttgggatgaagaaattgatgatgatgatgatgataattgcaataatgatgaagatgaagttcgagtgatagaatttaagaaaaaacatgaagaggtttctcaatttaaagaggaaggtgatgcaagtgaggactccccactgagcagtgccagttcccaagctgtgacacctgatgagcagccaaccttagggaagaagagtgatatctccagaaatgcttattccagatacaatacaatatcctatcggaaaatcagaaagggaaataccaagcaaagaattgatgaattcgagtctatgatgcatttataaactaactggaactgagaaattctcatgcccactaaaggaaaagctaattctattgccccagggtgcatatttctatgccttatttgagttatcacttggagggaggtggaagttgactctctttttcactgtagaataatgtggaaataaccctagataaaaattcagtctgataacctcaaatcaaaaagctttaaataaattcttgggcatttatcttttaaaacttcactaatatagcattgtgtgataagcactaagcagtcagt

SEQ ID NO: 2890 - DNA, 5697 bp, Homo sapiens
gattgggccgctgtcaggtgtcgctgcctgcaggttcggctgcgcgagcggagggaggcgggactcaagagtagccttcctcgaggacctgcctttcccatttgctgcctgaagttaatgtttcttgctggccaaatcagggacatgccggcattagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatcaatgatctggccatgcagtattacatccaagataggagggaggtgtaccggatcctgcaggaagagggtattgatctgcctcgatatgctgtgctcaaccgtgatcctgcccggcctgaggaatgcaacctgatagaaggtgaagaccaagtagaggtcaatggagctgtctttcccaagccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaaggtgtatacagtggggccagattatgcccatgctgaagctagaaaatctccagctttggatgggaaggttgaacgagacagtgaggggaaagagattcgatatccagtcatgctgactgccatggaaaagctggtggccaggaaagtctgcgtagctttcaagcaaacagtttgtggatttgaccttcttcgtgccaatggtcattcctttgtgtgtgatgtcaatggctttagttttgtcaagaactcgatgaaatactacgatgactgtgccaagattctggggaacaccataatgcgggagcttgccccacagttccagattccatggtccatccccacggaggctgaggacattcccattgttcccaccacatctggcactatgatggaacttcgttgtgtcattgcaattattcgtcatggggatcgtactcccaagcagaagatgaagatggaagtgaaacacccaaggttttttgctctgtttgaaaaacatggtggctacaagacagggaaattaaaactcaagcgacctgagcagctccaggaggtgctggatatcacaaggctgttgttggctgaactggagaaagaaccaggtggtgagatcgaggagaagactggaaaactagagcagctgaagtctgtactggagatgtatggtcacttctcaggtataaaccggaaggtacaattgacttactaccctcatggagtaaaagcttctaatgaggggcaagatccacagagggaaactctggccccatctctgttgctggtactgaagtggggtggagaactgactcctgctggccgtgttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctctgttatctcaggtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggccttccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatgagctcttgtttgtcccggccgtaaaacgattttctgtgtcgtttgcaaagcatccgactaacgggtttgaagggtgttccatggtgcctaccatctaccctctggaaacactgcataatgccctttccctacgtcaagtgagtgaattcttgagtagagtctgccagcgccacactgatgcccaggcacaggcatctgcagccctctttgattccatgcacagcagccaggcctcagataacccattttctccaccacgtactcttcattcacctcccctgcaactccagcagcgctctgagaagcccccttggtacagcagtggcccttctagcactgtgtccagtgctggtccttcttcccctactacagtagatggtaactcccaatttggcttcagtgatcaaccctccctaaattcacacgtggctgaagaacatcaaggccttgggctgctccaggagacccctgggagtggagcacaagagctctccatagaaggggagcaagagctttttgaaccaaatcagtccccacaggtgccacctatggaaaccagccagccatacgaggaggtcagccagccatgtcaggaggtccctgacatcagccagccatgccaggacatttctgaggcgctcagccagccatgtcagaaggtccctgacatcagccagcaatgccaggagaaccatgacaatggtaaccacacatgccaggaggtccctcacatcagccagccatgccagaagtccagccaactgtgccagaaagtctctgaggaagtttgccagctatgtctggagaactccgaggaggtcagccagccatgccagggggtctctgtggaggttggcaagctggtccataagttccatgtaggggttggtagcttggtccaggaaacccttgtagaagttggcagcccagctgaagagatccctgaggaggtcatccagccataccaggagttctctgtggaggttggcaggctggcccaggagacttctgcgatcaatctgttatctcagggcatccctgagattgataaaccatcccaagagttccctgaggagattgatctgcaggcccaggaggtccctgaggagataaattagaagtcctgggtggtccctgaagtgattgatcagctgcctggagagggtattcctcaagcccagcatccatctggtgatccaaaccctcagagccagtctctagcccatgaccagcactcaccccttccaccagcaacatgtgattaattttctcattagtggtatcacactataccagccatttgagccagcaaccttttctgttggctaactcactggccagctctcaccagcggtgtctggggaagtagttctctttgtatgaagcatacctgtgccagagctgtggttgaggaggagccagttttaggttcgaagaagccattggctcctcacttagccattagacttgaataggatttccttggggtgggttggtctgtcattacccagccttctctgagcatcctaggaaatcacagattgttaaaggaaatgccgcttcactgctgaagacaccatctggcgacagcaaatgcaaaagaggggactctagggtcttcacttttctggggaaatgttcacgacttctcaaggtacgcttagaccatatgtgcattcaggggactcttgtctttgccagcactcctcaggtgagcccgggatggctatctgaaatgtctggaaaatagagtcccttccccaaacatctgacatggccactaaatctttagacttgccttatagatccttccatatcatccccaagtgccccttctgcctcagtcctgttcctctgggcaatagctctagggaaaagtaggtattagactgctgtgcaaaattcagagcaactacttaaaatgctctagaggattcttagccagtctgtgaaagtgggcctcctctgtggtggggctgtttggcttaggagatgctgtagtagtagagataatcaggttctattttaagcaatcagcagagatcaatattgtacagatacaagcaaaggtttaataaatatatatatatatatttatttctgtagttgtgccagggacagactggccaaagaccaaacactgcagggtccccaagaaatttgtccttatatcattgtgtctgagggccagatatgattatgaagctttttccaaagatccagggatgggaatgggagtgggtaggaggggtaatgcggtcattggagtcgggggctggaacattatgagtgctcaataaatataaactaatgagaatggtggtgatgga

SEQ ID NO: 2891 - DNA, 1287 bp, Homo sapiens
agactacccgggccctcacagaaggcggtggcgggcgggtgcagcgagtttgtccccttgcccgcacactgcttggcctctgtacttaagtgcggtggccgcctgcctcgctggagcttctctgccgcagccatccgtgctgcttgggacgggccggggcgcgaaggcggtcgcatccatcgctctgccctcctgcttctcttgtgtaatcagctgcctatttggaaattgggcagggtttgcgactggatgctaatgtcactgactagttttcagcctaccatccagaagtaacatgttcccagctttggaaacgcacctaaagcagactattcctgatccttatgaagactttatgtaccgtcacctccaatattatggctactttaaagctcagagaggcagtttaccaaactctgctacgcatcagcatgttcggaagaataaccctcaatgcctgttgaatggctctcttggggaaaaagatgatttgataccagacaccctgcaaaaggagaagcttctatattcacatatgctgagtttaccacatcttaggagcagacagcttctttatgatgagttggatgaagtaaacccacgtcttcgagaaccccaagagctcttttccattttgtctaccaagaggccactgcaggctccaagatggccaattgaatgtgaggtcatcaaggaaaacatccatcatattgagtgggctccacctcaaccagaatatttctatcagcctaaaggaaatgaaaaggtaccagagattgtaggagagaaaaaaggaacagttgtctatcaattagattcagtgcctatagaaggttcctattttaccagttccagagtgggaggcaaacgaggaattgtcaaggaacttgctgtcacgttgcaaggaccagaagataatactctactgtttgaatcaaggtttgagagtgggaatctgcaaaaagctgtcagagtagaccctatgagtatgaactcaccttgcgaactgacctctacactaacaaacacactcagtggttttattttcgtgttcagaacaccagaaaagatgctacctatcgcttcaccattgtcaacttgctaaaacccaagagtctttatactgtagggatgaagccactcttgtactcccaattggatgccaacacccgcaatattggctggaggagagaaggaaatgaaatcaagtactacaagaacaacacggatgatgggcagcagcccttctactgtctcacgtggaccattcagtttccatatgaccag

SEQ ID NO: 2892 - DNA, 1293 bp, Homo sapiens
gttgctaccggaatgcctcttcaggttagcgattacagctggcagcagacgaagactgcggtctttctgtctctgcccctcaaaggcgtgtgcgtcagagacacggacgtgttctgcacggaaaactatctgaaggtcaactttcctccatttttatttgaggcatttctttatgctcccatagacgatgagagcagcaaagcaaagattgggaatgacaccattgtcttcaccttgtataaaaaagaagcggccatgtgggagaccctttctgtgacgggtgttgacaaagagatgatgcaaagaattagagaaaaatctattttacaagcacaagagagagcaaaagaagctacagaagcaaaagctgcagcaaagcgggaagatcaaaaatacgcactaagtgtcatgatgaagattgaagaagaagagaggaaaaaaatagaagatatgaaagaaaatgaacggataaaagccactaaagcattggaagcctggaaagaatatcaaagaaaagctgaggagcaaaaaaaaattcagagagaagagaaattatgtcaaaaagaaaagcaaattaaagaagaaagaaaaaaaataaaatataagagtcttactagaaatttggcatctagaaatcttgctccaaaagggagaaattcagaaaatatatttactgagaagttaaaggaagacagtattcctgctcctcgctctgttggcagtattaaaatcaactttacccctcgagtattcccaacagctcttcgtgaatcacaagtagcagaagaggaggagtggctacacaaacaagctgaggcacgaagagcaatgaatactgacatagctgaactttgcgatttaaaagaagaagaaaagaacccagaatggttgaaggataaaggaaaacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaag

SEQ ID NO: 2893 - DNA, 582 bp, Homo sapiens
ttttcggaggctgccagcgtcccacaccagccgcaggtgaaaaccggcagaaagacattaagagattttcctgcagtcactgctggcagatgatagagccaggatttgaaagcaggcagcctggctccagaccctgtgctcttaactcccgttttgcatcaagaacagaatcctatgaaaggcttgcacagtgcttggtactgagtaggcactccgatagcagcatcaaggagcattgtgtacatgcagaagtgcacagtacctggagtgaaactgcttgtgttcgatttctgataccattcataactggctgtgtgatctcaaataagaaaactgaagaaccagctgggcgcggtagctcacgcctgtaatcccagcactttgggaggctgaggcgggtggattacctgagaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtct

SEQ ID NO: 2894 - DNA, 2423 bp, Homo sapiens
atggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtcataaataaagttcatcttaaggcaaatcatgtggtcaagagagatgttgatgagcatttaagaatcaagactgtctatgataaaagtgttgaagagttgctccctgagaaaaagaatcttgtaaagaacaagcttttcccacaagcgatttcttatttagagaagacttttcaggtccgtcgacctgcgggcactatcttacttagcagacaatgtgcaacaaaccaatacctccggaaggaaaacgatcctcacaggtactgcaccggggagtgtgccgcacacacaaagtgcggccccgttattgttcctgaggaacatctccagcaatgccgggtctaccgtgggggtaagtggcctcatggagcagtgggtgtgccagaccaagaaggcatctcagatgcagactttgttctttacgttggtgctctggccaccgagagatgcagccatgaaaacatcatctcttatgcagcctattgtcagcaggaagcaaacatggacaggccaatagcaggatatgctaacctgtgtccaaatatgatctctacccagcctcaggagtttgttgggatgctgtccacagtgaaacatgaggttattcatgccctgggtttctctgctgggctgtttgcattctaccatgataaagatggaaatcctctcacttcaagatttgcagatggcctcccaccttttaattatagtctgggattatatcaatggagtgataaagtagttcgaaaagtggagagattatgggatgttcgagataataagatagttcgtcacactgtgtatctcctggtaacgcctcgtgttgttgaggaagcacgaaaacattttgattgtccagttctagagggaatggaacttgaaaatcaaggtggtgtgggcactgagctcaaccattgggaaaaaaggttattagagaatgaagcgatgactggttctcacactcagaatcgagtactctctcgaatcactctggcattaatggaggacactggctggtataaagcaaattacagcatggctgagaagttagactggggccgaggaatgggctgtgactttgtcaggaagagctgtaaattctggattgatcagcagagacaaaagagacagatgctgagcccttactgtgacacgctcagaagtaacccactgcagctaacttgcagacaggaccagagagcagttgccgtgtgtaatttgcagaagttccctaagcctttaccacaggaataccagtactttgatgaactcagtggaatacctgcagaagatttgccttattatggtggctccgtggaaattgctgactactgccctttcagtcaggaattcagttggcatttaagtggtgaatatcagcgcagctcagattgtagaatattggaaaatcaaccagaaatttttaagaactatggcgctgaaaagtatggacctcattccgtttgtctaattcagaaatcagcattcgttatggagaagtgtgagaggaagctgagttacccagactggggaagcggatgctatcaggtttcttgttctcctcaaggtctgaaagtttgggtccaagatacttcatatttgtgtagtcgggctgggcaggtcctccctgtcagtatccagatgaatggctggattcacgatggaaacctgctctgcccatcatgttgggacttctgtgagctctgtcctccagaaacagatcctccagccactaacctgacccgagctctgccacttgatctttgttcctgttcctcgagcctggtggtcaccctctggcttctgctaggcaatctgtttcctctgctggctggatttcttctgtgtatatggcactaggaatggaaaagtggatcttcaagatattcttttatgttatgttcttgtgaacaaagcacaaagtttgagtgagtgccaacctatgcagatggtagaagtggcattcctggctttggcttggaagaattgacgaccatcagaccttgaagcagaacttcacagcagcctgtcctcatcagcaacccaaccaccttcatcagcaacccaaccaccttcatcagcaacccaaccacctcgtcagcaacccaaccacctcgtcagcaacccaaccacctcgtcagcaacccagccaccttcatcagcaacccaaccacctcatcagcaacccagccaccttcatcagc

SEQ ID NO: 2895 - DNA, 3468 bp, Homo sapiens
gcgagccgaagcgcgggaagcagctcttgtggatcctcagtggcggaggctcggtcacccggataggtaaaggaaaacatgcctgccacacggaagccaatgagatatgggcatacagagggacacacggaggtctgttttgatgattctgggagttttattgtgacttgtggaagtgatggtgatgtgaggatttgggaagacttggatgatgatgatcctaagttcattaatgttggagaaaaggcatattcatgtgctttgaagagtggaaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgatggatagcagccaacagaaaacatttcgaggacatgatgcccctgttttaagtctttcctttgatcctaaggacatctttctggcatcagctagttgtgatggatctgtcagagtgtggcaaatttcagatcagacatgtgctattagttggccactgctacaaaaatgcaacgatgtgataaatgcaaaatcaatctgcagacttgcttggcagccaaaaagtgggaagttactggcaattcctgtggaaaaatctgttaagctatatagaagagaatcttggagtcatcaatttgatctttcagataatttcatctctcagaccctcaatatagtaacctggtctccctgtgggcaatatttagctgcaggtagtattaatggtctaatcatagtttggaatgtggaaaccaaagactgcatggaaagggtgaaacatgagaaaggttatgcaatttgtggtctggcatggcatcctacttgtggtcgaatatcgtatactgatgcggaaggaaatctagggcttctagagaatgtttgtgaccccagtggaaagacatcaagcagtaaggtatctagcagagtggaaaaggattataatgatctttttgatggagatgatatgagtaatgctggtgattttctaaatgacaatgcagttgagatcccttctttttcaaaagggattataaatgatgatgaggatgatgaagacctcatgatggcttcaggtcgtcctagacagcgaagtcacatcctagaagatgatgaaaactcagttgatatttcaatgctaaaaactggttctagtcttctcaaagaggaggaggaagatggtcaagaaggcagcattcacaatctaccacttgtaacatcccaaaggccattttatgatggacccatgccaactccccggcaaaagccatttcagtcaggttctacaccgttgcatctcactcacagattcatggtgtggaactctattggaattattcgctgctataatgatgagcaagacaatgccatagatgtggagttccatgatacctccatacaccatgcaacacacttatcaaacactttgaattatacaatagcagatctttcccacgaagctattttgttggcatgtgaaagcactgatgaactagcaagcaagcttcactgcctgcactttagttcttgggattcaagcaaagagtggataatagacttgcctcagaatgaggatattgaagccatatgtctcggtcaaggatgggctgctgccgctactagtgccctgcttcttcgattgtttactattggaggggttcaaaaagaggtattcagccttgctggacctgtggtgtcaatggcaggacatggagaacagcttttcattgtttatcacagaggtacaggatttgatggggatcagtgccttggagttcaactgctagagctggggaaaaagaaaaaacaaattttgcatggtgaccctcttcctcttacaaggaaatcctaccttgcatggattgggttttcagctgaaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgcattccttgtaaaggttctcggtttcccccaacccttccacgccctgctgttgctatattatcctttaagcttccttactgtcagattgcaacagagaaaggacaaatggaggagcaattttggcgttcagttatatttcacaaccaccttgattatttagctaaaaatggttatgaatatgaagagagcactaaaaatcaagcaacaaaagagcaacaggaacttttaatgaaaatgcttgcgctttcttgtaaactggagcgagaattccgttgtgtggaacttgctgatctaatgactcaaaatgctgtgaatttagccattaaatatgcttctcgctctcggaaattaatactggctcaaaaactaagtgaactggctgtagagaaggcagccgaattgacagcaacccaggtggaagaggaagaagaagaagaagatttcagaaaaaagctgaatgctggttacagcaatactgctacagagtggagccaaccaaggttcagaaatcaagttgaagaagatgctgaggacagtggagaagctgatgatgaagaaaaaccagaaatacataagcctggacagaactcgttttccaaaagtacaaattcctctgatgtttcagctaagtcaggtgcagttacctttagcagccaaggacgagtaaatccctttaaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcaggcatctgcagcatcctatttccagaaaagaaattctcaaactaataaaactgaggaagtgaaagaagaaaatcttaaaaatgtattatctgaaaccccagctatatgtcctcctcaaaacactgaaaaccaaaggccaaagaccgggttccagatgtggttagaagaaaatagaagtaatattttgtctgacaatcctgacttttcagatgaagcagacataataaaagaaggaatgattcgatttagagtattgtcaactgaagaaagaaaggtgtgggctaacaaagccaaaggagaaacggcaagtgaaggaactgaagcaaagaagcgaaaacgtgtggttgatgaaagtgatgaaacagaaaaccaggaagaaaaagcaaaagagaacctgaatttgtctaaaaagcagaaacctttagatttttctacaaatcagaaactatcagcttttgcatttaagcaggagtaa

SEQ ID NO: 2896 - DNA, 1544 bp, Homo sapiens
gatgtcacgtccggcggcggcggcagcggcagcggcagcggcgctgagttttgtctcccgggccgtctgggcgcgcgcgggtgtcccagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttggaaggcataaatgttggctgactgtcaaatgcttgtgggaggtccccacggagtggagaagcgggagactcagcttaatcacagacaaagttgtgcatgagagacggagtctcactctgttgcccaggctggagttcaatggtgcaatgatctcggctcactgcaacctccgcctcttgggtgcaagtaactctcctgcctcagcctcccgagtagctgggattacaggtcccttcagagccgtgaaggcgggcatcctgtgacacagctgacacagcatggagccttcatctcctatgtgcgtttcttaggtcactctgaggggtggggccacaagctaccacctacagaattgatacctttagttcaaagccattgaccaacccaggttcatgaattttcaggcagaaggtaccaagacaaccccattaggcaactaggaagacaggccaggaaaggcctacgatgtcgtcattacagctgccaccgtcagagggttcattatgtgctcagaggtgcacagggcctcactggctgctggacagaacaggggctgctcccaggaccaggcagggtggggctggaaaccaacccaaggctctcaaagctccagggctgagccatggcatctctgtgccctgttccccaccacccaacaccgagcagttcctcaaatggctgaaagctcagaaaatcagttttaaaacaaactattggaggatgttttcttataccactagacattttttttgtttaacaatcgcaatagattaaatttaaaaaaatatttaggagaacatagttccagaatacagggaaaaataagaacctatgggaaaacaagttgatttctgaaaagtttcaaaactatgaaatgaccaacctgttagaattggtcaagtagttctttaatttgcaactatgtggc

SEQ ID NO: 2897 - DNA, 3189 bp, Homo sapiens
atgatcagcaagggtggcagtgaagctcttctgcagaccctggtagacacagcgaggacagctcctccagactatgacatcctcctgcctctcttccggctgctggccaaagttggcctaagagataaaaagattggacggaaggccctagaattggaagcacttgatgtgacattgattctggccaggaagaacctatcccatggccagaatctcctccactgtctctgggctctgcgtgtgtttgcctccagtgtctccatgggagccatgctgggaattaatggagccatggaactgcttttcaaggttattactccttacacccgaaagcgcacccaagcaatcagggcagccactgaagttttggcagcattgctgaaatccaagtcgaacggccgcagagcagtgaaccgaggctacgtcaccagcctgctcgggctgcaccaggactggcacagccatgacacagccaacgcctacgtgcagatccgacggggcttgctgctctgcctcaggcacattgctgccctccggtccggcagggaggccttcctggcagcacagggcatggagatcctcttcagcaccacacagaactgcctggatgacaagagcatggagcccgtcatctctgtggtgcttcagatcctgaggcagtgctaccctacgagtccacttcccttggtcacagccagcagtgcctatgccttcccggtccccgggtgcatcaccactgaacctccacatgatctacctgaagaggattttgaagatgatggcgatgatgaagtggacaaagactctgatactgaagatgggaaagtggaagatgatgacttggaaacagacgtgaacaagctgagttccaaacctggtcttgaccgacctgaagaggaactgatgcaatatgaggtgatgtgtcttgagctctcctatagctttgaggaactgcagtccaaacttggagatgatttgaactctgaaaagactcagtatgccaatcaccaccacattccagccgctgcctcctcaaaacagcattgctacagcaaggaccaaagctcctgtgggcaagaaagagaatatgctgtccagacttcccttctgtgcagggtgaagacgggaaggtccactgtgcatctaggctccaaaaaaaatcctggagtgaacctgtaccaaaatgtgcaatccaatagtctcaggagagattcttctgaaagtgaaatccctgacattcaggcttccccgaaagcagatgcctgggacgtagatgcaattttctgcccaaggatgagtgcctccttttctaattccactaggactagagaagttgtcaaagtaatagataagcttctgcagacacatctgaagcgtgtccctttccacgatccctatctttatatggccaaagccagaagaaccagctctgtggtggacttcaagatgatggcatttcctgatgtctggggacactgtccccctcccaccacccagcctatgttggaacgaaaatgtggagtccaaaggatcaggatatttgaggatattcggaggctcatccagccaagtgatgttataaataaagttgtcttcagtttagatgagccttggcctttgcaagacaatgcttccaattgtttacggttcttctccaaatttgagtcaggaaatcttcgcaaagccatccaagtgcgtgagttcgagtatgacttgctggtcaacgcagatgtgaatagcacccagcaccagcagtggttctatttcaaagtgagcggtatgcaggcggccatcccttaccacttcaacatcatcaactgtgagaagcccaacagccagtttaattatgggatgcagcccaccctatattctgtgaaggaggctcttcttggcaaacccacctggataaggacaggccatgaaatatgttattacaaaaatcattatcgccagagtacagctgttgcaggcggagcatctgggaagtgctactataccctcacctttgctgtcaccttcccacacagtgaggatgtctgctacctggcctaccactatccctatacctacacagccctcatgactcatcttgacatcctggaaaagagtgtcaacctcaaagaggtctacttccggcaagatgttctctgccagacgctgggagggaatccgtgtcccttggtgaccatcacggccatgcctgagtccaacagtgatgagcatctagagcagttccgacatcgtccatatcaggtgatcactgctcgagttcatccaggagagagcaatgccagttgggtgatgaagggtaccttggagttcctggtcagcagtgaccctgtggctaggctcttgagggaaaacttcatcttcaagatcatacccatgctcaacccagatggtgtcatcaacggcaaccacagatgctcactgagcggggaagatttgaacagacaatggctttctcccagtgctcatctgcagccaaccatttaccatgccaaaggcctcctctaccacctgagcagcattggccgaagtcccgtggttttctgtgacttccatggccactcccaaaagaagaatgtgttcctttatggctgtagcatcaaggaaaccttgtggcaagcagcatgcactgtgggcacatctactatcctagaggaggtcaactacaggactcttcccaaaatccttgataagctagcaccagcattcacaatgagcagctgcagctttctcgtggagaaatctcgagcttccacggcccgggtggtggtgtggagagagatgggggtgtccagaagctacaccatggaaagcagctactgtggctgcaaccagggcccttatcagtgtacacagaggctgttggagaggacaaagaatgaaagggctcacccagtggatggccttcagggtctacagtttggtaccagagaactggaggagatgggagccatgttctgtttgggcctcctcatcctggagctcaaatctgccagctgcagccatcagctcctggctcaagctgcaactctgctgagtgctgaggaggacgctctggaccagcacctccaacgattaaaatcatccaatttcctgccaaagcatatttggtttgcttaccacttttttgccattacaaactttttcaagatgaaccttcttctgcatgtctccccgtga

SEQ ID NO: 2898 - DNA, 1001 bp, Homo sapiens
gacttggacgtgcgagtcaacaaggtacaggacacatttctctccggggaaatcttgtgtgggcgccgaggcccggacgtagcaaccaaacgtcgggaagaggcgccaaaaggatgctgggcctggctccttgaagcccgggttttcccttttgagagccacaaccaagaaataaaaatctagcaaagagggggccactttctgcggcgagatacgccctctcggccgctcctccagctcccaggccccctccctactcgacggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaaga

SEQ ID NO: 2899 - DNA, 544 bp, Homo sapiens
aacaacaaaagccaagccaaaagccaaaacaaacaaatccagccaaatcaatcattgagaaacaataatattaataaaatccaaaactaaatcaaaccaatcaaggcaccaagacgcaggggggatatccacagttcgatcaaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagcttaaaaaagtgaggaggaagtaaatgctaaattattcatgagcctcatttgacagcacatcagaaggggaagtgtcaggggttttataaagggcataaaatcttgttattttaatttgcatctgggagaatgtctgagcaaggagacctgaatcaggcaatagcagaggaaggagggactgagcaggagacggccactccagagaacggcattgttaaatcagaa

SEQ ID NO: 2900 - DNA, 373 bp, Homo sapiens
ggtcctaggctcacctaagccagaagagattccccttacttggatacaaccaggaactactgttctcaactgctcccatgacttcctgtcagaaagtttgattatcattagaagaatggccatcttttaaagtgattcattgacttgtccctggagaaatcatgagttagatgagagtgtttagtgggaagtgaaaagacccgtccacggtttcggatgagatcctcgttggactgtgatcccaggatattacccaggcccagatcgtagacaacctcccaatggagtcctgcccctacacgggcagggggtgaaataatgattccctttcttaattttctttagccatgaaatttattaaaaatgtatgtct

SEQ ID NO: 2901 - DNA, 589 bp, Homo sapiens
tgagaagcagtttggacccagctgaaaaattttatttatggagacttgtaatcagcctgatatacagagaacactctggactggaaatatagtcagatcctgtgttgccataagcccttggcccacatttaagtgggaatgcagctagcttggatgtctgaaactttgtaggcgcctctgtctgaatcctgaacacaggcaccaggactactgagagctcgtcatctgtgcaggatagccacacagcaaacatgtttgcaaaactgaagaagaaaattgcagaagagactgctgttgctcagaggccaggaggtgctactaggatcccacggtctgtgagcaaggaatcagttgcctcaatgggagctgactcaggagatgactttgcttccgatggaagcagctccagagaagatctttcatcccagcttctgagaaggaatgaacagatacggaagttagaggccagactttctgactatgctgaacaggtccgaaacttgcagaagataaaagagaagcttgaaattgcattagaaaaacaccaggattcttccatgcggaaatttcaagagcagaatgagacatt

SEQ ID NO: 2902 - DNA, 2018 bp, Homo sapiens
aaaactccagcccgaagggatctggaagcagtttttaagactgtgtgtgtatgagacaggtcgcgtcctagagcaaacggttttttttgtaaacagacggcatcctaacaggggcggtgctacccagtctgcggggagtcgctcgggatcgaagcacctcagagctccttcgagcgtatcccttcgggaaagccccacgccttccccgaggcgcctcctccggcctgcagcacgccctcgtcctgcacttcctcctcggaatctgcaagacagagtctagctctttcacccaggctggagtgaagtggtgcaatctcagctcagtgcaacctccgccccctgggttcaagtgattctcctgcctcagcctccccagtagctgggattacagtgatatcctgagagaagatgggaaagggctgcaaggttgtggtttgtggattgttatctgtggggaaaactgcaattttggagcagctcctttatggaaatcatactattggaatggaagattgcgaaacaatggaagatgtatacatggcttcagtagaaacagaccgaggagtaaaagaacagttacatctttatgacaccagaggtctacaggaaggcgtggagctgccaaagcattatttttcatttgctgatggcttcgttcttgtgtacagtgtgaataaccttgaatcctttcaaagagtggagcttctgaagaaagaaatcgataagttcaaagacaaaaaagaggtagcaattgtggtattaggaaacaaaatcgacctttctgagcagagacaagtggacgctgaagtggcacagcagtgggcaaaaagtgagaaagtaagactgtgggaggtgactgttacagatcggaaaactctgattgaaccattcactttattagccagtaaactttctcaaccccagagcaaatcaagctttcctttgcctgggaggaaaaacaaagggaactctaattctgagaactaaaaatcagtaatttccacaattgtatgttgaatagtgattgcctttaagtgtctgtgaacatggagtaatattactatttaaaataggccatttgtatctacctttggtccttaggaaaattcctaaggaagtcaattaatgcactttagatgttaaaagtatttgggctaaggttattattgcctgatatgaaataatatattcttattctcattgtttgaaacctgtctttgaaattagcacctttgttatttatgttgtacttgtgaaaacagtaaaatagtttggatagttatgcaaatgcacctatgtgtaacttccccccaaccccaagctgtttcggaagatatcataatcattctgtgtaacattatgcaaacttctaagcccaaacatgactttgtttttaaaaagttcattaatctaatgtctaggattataaaacatttttttgtgtctaaattggacccaaaacattgaacagtttggggtagtaagctaaatttcatcttgtggagattttgctaaacagactaagacccatgatttagctttgctcaaattagaatgtttagcatgagttgaggtaccaggtagtgttaagtaggttcatcacgctctaaggccgttttttccttagccagacccctgttgatagaccagatacttgagggcaaactgtttgctcctcctcttgaaaatgattaggcacttaaggacagtaaagctgtattttctggaaggaagactgtatcttctggaatagttttctagaaaactagtcatatacaataaaagtatcaaaaatattgggctctaatttgatctgacttagatgtctgagtttgtgttgtttctctaaagattttggcaagactcaagcaatgtggctgactgtaactttattaatttaaaaggtaggaagtaagctacttagtggtttcacctgtgaaataactattttgactgaaatgtaaaataagctattcaacaaagaacatattaaaacatcaagtaatttgtaacatctt

SEQ ID NO: 2903 - DNA, 2818 bp, Homo sapiens
gctcgggaaaggggttcggaaccggtctaggctcaagttaaatctccctctaaagagccaacactggtttctttggcgactcggtttctactctaaacaggtcccgctccacagtctgggcgggcctgtgtgtgcgttgagtagcctctagcgtgaaaacttcatggttaaaagggaagtaccggaggcaagaaatagctttcgaggcactggtttgttagagtagtggtacgtagtgcgccgccctgaacgggggctgagacgctgcttttccagaagtgccagtgaggacgtggcaagaccgcctcggacgtacgcttcctctacctcagcccgtcgggttaggggcgcgggaggcgcagaggctgctgggaacgcgcatgcgctcagcgcggcggggagtccacctttaacgtccgcgggcgcggggtgtgtcgggtgtcgacggcggcgctttgcggccggtcgtgcgggtcgggcgcgggcgggcgcggcggcagtggcgcgcacaggtgattgactggccagctgcctgaaggagcgccaggtcctccttgctggcaggtggcgaagcccattggggcggcggtgcagaccgcggcggcggctgcggcggtctggctcgggaggcgttcctggggccaaggccatggccccgcggctgcagctggagaaggcggcctggcgctgggcggagacggtgcggcccgaggaggtgtcgcaggagcacatcgagaccgcttaccgcatctggctggagccctgcattcgcggcgtgtgcagacgaaactgcaaaggaaatccgaattgcttggttggtattggtgagcatatttggttaggagaaatagatgaaaatagttttcataacatcgatgatcccaactgtgagaggagaaaaaagaactcatttgtgggcctgactaaccttggagccacttgttatgtcaacacatttcttcaagtgtggtttctcaacttggagcttcggcaggcactctacttatgtccaagcacttgtagtgactacatgctgggagacggcatccaagaagaaaaagattatgagcctcaaacaatttgtgagcatctccagtacttgtttgccttgttgcaaaacagtaataggcgatacattgatccatcaggatttgttaaagccttgggcctggacactggacaacagcaggatgctcaagaattttcaaagctctttatgtctctattggaagatactttgtctaaacaaaagaatccagatgtgcgcaatattgttcaacagcagttctgtggagaatatgcctatgtaactgtttgcaaccagtgtggcagagagtctaagcttttgtcaaaattttatgagctggagttaaatatccaaggccacaaacagttaacagattgtatctcggaatttttgaaggaagaaaaattagaaggagacaatcgctatttttgcgagaactgtcaaagcaaacagaatgcaacaagaaagattcgacttcttagccttccttgcactctgaacttgcagctaatgcgttttgtctttgacaggcaaactggacataagaaaaagctgaatacctacattggcttctcagaaattttggatatggagccttatgtggaacataaaggtgggtcctacgtgtatgaactcagcgcagtcctcatacacagaggagtgagtgcttattctggccactacatcgcccacgtgaaagatccacagtctggtgaatggtataagtttaatgatgaagacatagaaaagatggaggggaagaaattacaactagggattgaggaagatctagcagaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtagatcgggataattccaaatttgaggagtggtgtattgaaatggctgagatgcgtaagcaaagtgtggataaaggaaaagcaaaacacgaagaggttaaggagctgtaccaaaggttacctgctggagctggtctgtaagatattctgggacagcactgttgccattaagtgccttgtttttttatgttcacaaatgtatatgaagaaactttctcaaacttactctttctaataacccactaaagccagcttaaacactctaaaagtactttgtaaaccaacaataacttgatgtgtagcattccatattatttcattacgttgtactcctaaaaatgggaagctgttaataaattataacatttaggtcagcactctgcatccatgagtattgtagatatttatattttgtgagatattaacttgtttaagaaaaatccgattggattactatggaaaaagcaacttgcctgttctgtttctttgcatactttgtgacctaacagttttaacagacattctattatatgaatacagtttttttgatactattagattaacttgaagtttaataccaaatattatgctaagagtagaaaagctttctgctgacccctgatttcttagaaatatcccacataatccagcttatcccttttctgtatatgtttattcaggtttacctgatgtctcaaaatgaaaccaaattaagcctttttaaaggctgatgtgccatttgtattaagttatctttgtcattttaaagacatgaattccccaagcctaattcctacttaaggaagagagacaatttagtccttactttagaaaataaatacttaagcataa

SEQ ID NO: 2904 - DNA, 3212 bp, Homo sapiens
acgctgggagctgcggacggcgggcgcgggctgggccgggtctagtggcggccgcacacctcgcgtcgtctggggcagtgttgcgcgtgcgctgatgacaggcccgacacgcccctcttacgtccgcgaacccgtcttcgctcagcctctcgcagctttgcgctcgtgggagagtcccgcctccttctgcgaaccgcaccacccagatcccggggtgcgcggagggcgcgtctctgacggaagccggggcggacggtcggagtccggaagaaaaacagtccgcgacagctaggcgcgtgagaccggccgcccgcagggctgctctggccgggacccgctggccgggagacgcgaacctgccggaccaccgcgcggggacgacggcggccatgagctcgcggaagctgagcgggccgaaaggcaggaggctcagcacatacatcaggaggtctgcctgatcccatggtgaaccccgggaatccgaaatcagattgagataagatcctttagggaagtgacttagcctggtctcttgcctgctctttcacggggaacaacgctaatcgcccacttagtctaagtcacgatgcttggatttgctgctaatcgtcggatttgagagtgggaacaagaaatccggacttttgctctccatcctcttagacatacacgtcgtgacttggaacgtggcttcggcagcgccccctctagatctcagtgacctgcttcagctgaacaaccggaacctcaatcttgacatatatgttattggtttgcaggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacctggggacagttctgcgtctcatttctggattcctaccccctcttctagtcttgcccaagtagtcctgccaggcacatgccccatttggcacaggcctgcattcttgtcgtgccgtcctgggcctcaggctgtctgggaggggagatgctcacatttgtacaggctacatagactggtgcaagcagtgctggattccaggagtcttggcatctcatagcttgtccccgtgaggagtgagcagagggtctgggatttctgctttcagcaaaagcagtctgactcagtgggcagaatggaggggcccctctagccaggctcttacgccatggttatgagcaggttgatgagggtccttcggccagcacaaccttcctccctactcacggcatggagtctgactgcatggaagttccagatcctgacagagagaactgggaaggatccaggttcgcttccgttggtagcttgagtcccatgcctccaccctgccatctgaggaaggggtgacaagtggtcaaggagctgtggccacagacttttccagggtggtccttggcaggtgaggtgcgtctgtgccacccttgtcaggagccattgacgacgggccccccctggaccccccgggacctcagagtgggggcaggcagaagggagaaccagctcaagacattttggaggatctggccctggggttcttcagagaacaccctctaggggctttggggacatggcctgtccccacatccagcacttgcctccgccatggtcactcggcagcccttttcccaggagaagacacctctgggagcctgctcagtgcttgtcctgccatcctgtgtcctgggactgagggttactccagttgctctgtgttgcatactctcccccgcaagcctgtgtatgaagaattgtcccctggcttccagcaggccatggctggctgttttgtgactgttacattgtgcaggggtaattattagcgtggctttt

SEQ ID NO: 2905 - DNA, 1874 bp, Homo sapiens
atcgttggtccgggcgccgcgagggcggggcccgcagttcggttgcgctgcggagcgcagctgtgagggagtcgccagtgcaggcctgagtgttccttccagcatgtcggagggggagtcccagacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctg

SEQ ID NO: 2906 - DNA, 756 bp, Homo sapiens
gacctttctgcccctggagtccccacgcaggctggagcccgagccccgagggcctgcgagctccgcggctcccacaggagaggttcaagaccctgcttaccatgactacgcgtggaggcggaaggaggcgacacggcctccagggctgggttagatcgtgatagacgtcgctccctgagcgcgtcctgggggcattagggagtcctggcagcgggccggaccgtgtccccgccagagctctgggctctggggatgacggagaggccgaggaggtgtgaagaagaatgttggagttcctgacagctggattctagaagtagaactatgagctcacctttggcctcccttagcaagacccgaaaagtgcccctgccctcggagcctatgaatcctgggaggcgaggaatccgcatctatggagatgaagatgaggtggacatgttgagtgatgggtgtggctcagaagaaaagatctcagtcccttcctgctatggcggcataggtgcccctgtgagtcggcaagtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggag

SEQ ID NO: 2907 - DNA, 2107 bp, Homo sapiens
gcgtggtgggcagtgtgggcatcccagcactgagttctgcccgggagaagccgacccctcccgcaatgcccgccccgccgtgcgcctcctgccatgctgcacgcgccgccctccgccgtccgctctcgggccaagcgctgtgcggtgcctgcttctgcgccgccttcgaggccgaggtgctgcacacggtgctcgccggccgcctgctgccgcccggcgcggtggtggccgtgggcgcctcgggcggcaaggactccacggtgctggcgcacgtgctgcgcgcgctggcgccgcgcctgggcatctcactgcagctcgtggccgtcgatgagggcatcggtggctaccgggacgcggcgttggcggccgtgcggcgccaggcggcgcgctgggagctgccgctcacggtcgtggcctacgaagacctctttgggggctggacgatggacgccgtggcccgcagcacagccggctccggccgcagccgctcctgctgcaccttctgtggagtgctgcggcgccgggcgctggaggaaggggcgcgccgcgtgggagccacgcacatcgtgacaggtcacaacgccgacgacatggcggagaccgtgctcatgaacttcctacggggcgacgcggggcggctggcccggggcgggggcctgggctctcccggcgaggggggcgccctgccgcgctgccgcccgctgcagttcgcctcgcagaaggaggtggtgctgtacgcgcacttccgccgcctcgactacttctccgaggagtgcgtctacgcgcccgaggccttccgcggccacgcccgggacctgctcaagcgcctggaggcggcgcggccgtccgcggtgctggacctcgtgcactcggccgagcgcctggcgctggccccggccgcgcggcccccgcgccccggcgcctgctcccgctgtggggcgctggccagccgcgcgctctgccaggcctgcgcgctcctggacggcctgaaccgcggccggccccgcctggccatcggcaagggccgccggggtctggacgaggaggcgacgccggggacgcccggggatccggcccggccccccgcctccaaggccgtccccaccttctagcgacttcgggcctcccgccgggatctgatgccgcggggtgggggctgcctgtaaatgacactgtgaataaacccgttaccttacctggccttccatgtggggttgggaaggagacgggggcccattcacctgaaaccctgaagaagctgggaccccagacttcgaggtctcagggaagaagggtctcgaactgggcttcaggctctgagggaggagggggctgggggaccatcctaggtctgagagaggagagggccaggactaagcctagaagaagtgggactggggaccccaggcatctgtggctgaggaaggagggcctggggtcgtggactcctgggtctcagggaggagggggctgaacaccgtgtgattcttgagcgagtggggattggttggggacctcctgcccagggcctctgctggttctgggtgcgctcagcatggtcctgaccctccttgagcatcagattcctgatgtttcctgtttgcccgcagtggggtaagcggagcgtgacttgatggacacacgccattcacagccgccgtcacgatgcctcccttccagcgcttcgtgtgtagcacgcactgcaccctcatttcgtctccaccacggtctcactggctgtagcctgaagtggtaaatggccctaagacacccagtcggaaggggtcacaccgagggctccctccaaagctctcgaatatcacaggtcgtggaattggtcctcccccacccatcccctctcgaatctctcctggtatctctgtcacgggtgaggaggggttggatgcgttccccaaaccttggactctggaggcagggttgtgtgagcctgtcggtgacttagcctctttcatgtcccatttctcctatgaaaatataatcagcccccttcccccccgcccccccatcccccccgcatcaaggcaccactgggaggaaatggaagatcagagaagttgaggtgctcaataaatggtgaccacttgga

SEQ ID NO: 2908 - DNA, 564 bp, Homo sapiens
gaaatgtgtatgtcatgtgtccaaattgtaagatacttgctgtaagtagcaaaaagatgggaaggaaagtctacagaccaaatcatatctgaatctccccattctccctctccacaaatattggtttaggaattctccgaagtttgaaggttatgaatggttatcactcaaggattcagaactaagcagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccat

SEQ ID NO: 2909 - DNA, 559 bp, Homo sapiens
aaagtgaggtcatgaatacaacagcatctcgtgttcgctacgtttcctctggaattagcccacaagcagaccccttgctctcctagtggcaattaaccatgaccatcttcctggagaagagaaactacctggcaaagggccaaagtcttaggactgctgggcaggagaactggcctgtgttcaagttgagtcccagtttctgccgctttatctttcccgcctcccggcaggcaggccgttaaccgtcttccggaagacgctgctagaaccctccggccgctcctgcccgccatcgtccccgaacgacactcgctcagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacgg

SEQ ID NO: 2910 - DNA, 2338 bp, Homo sapiens
atccttccgcagctgcacgacgcctgtgtgtctggcctttccttcttcttctcttccccggcagcacagtgtggctgtttgtctccttgcccgccaaagttctgcccagtccaacgactccacgcagctcgcccttggttatttggacaagaggcacattgacccaatttggagacgtattttggaaggaggcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaacttgaatgtgatttgcagcagagggaggaagagattgctgaattgcagaaagctctaagtgatatgcaggtctgcctcttccaggaacgggaacatgttttacgcctctactcagaaaatgaccgactgagaatcagggagctagaagacaagaaaaagattcagaatctcttggctcttgtgggaacagatgctggagaagtgacctatttttgtaaggagcctcctcacaaagtcaccattctccaaaagactatccaggctgtaggtgaatgtgagcagagtgaatcttcagctttcaaagcagatcctaaaataagcaaaagaagaccatcgagagagagaaaagaaagttctgagcattaccaaagagacatacagacactcatcctacaggtggaagcactgcaggctcagctgggagagcagaccaaactttctcgagaacaaattgaagggctcatcgaggacagacggattcaccttgaggaaatacaagttcagcaccagagaaatcagaacaaaatcaaagagctaaccaaaaatcttcaccacacccaagaactgctctatgagagcaccaaagattttctgcaactcagatctgaaaaccaaaataaagagaagtcatggatgcttgaaaaagataatttgatgtcaaagattaagcaatatagggtgcagtgtaagaagaaagaagataaaattggaaaagtgttgcccgttatgcatgagagtcaccatgctcaaagtgaatatattaagtccctaaaagataagttagtacaagagaaaaagctgtccaatatgtaccaagagcagtgcatttccttagaagaagaacttgcccgaattcgtgaggaagagggaatgaggagagagatcttcaaggatcgcactaacaagatggggaagcgtttacagataatgacaaaacgctatgaggcattggagcgtcgacgtatcctggaagtagaaggctttaagacagatattaaagttctccgacagaaactgaaagacttggagcaaatgttgtataaggcaacagttaatgcccgggcaaaccaggatcttgcccttctgtgtgaggtccgtgacagcaatagacgggcacataagatacaaggagaactgaagaatcttaagtcgaaagtgtttggtctggagaatgaacttagactctgttaatgtctacttttggaaatggcccccatttagaagaggtgtgcttcttgaaacctgaggacaaggtcatctgctgccagaaaatgtaaacctgagttgactagagtggtggtattcattattgtaaagacagcttgaagaatcggggaccactaggaaagcttttcttgcatactcagcttgctttatcatttttgctgtccttttaacacttgcgaggagtaggggcctggtcctgaatgacttggaggctttcattatttatcctgtctgtattgaccggtttttgttttttcagaaggcagtgatgatgaaaacttaggaagaaggtattttgcaataagcttggctgagtgtccatgggaagaatactttccctaaagagagagaagcactcacagaggctgcctttctcctgagctcggggagaaggcagcacatcacaacctgtcacattgaaataggcgctcattctgctatttcaccttccgtcctgagcagagcctgaattacgtttttgggcaatttcatggtgtttcaccagagggcgctagagactcaaacgaaatgtccatctggaaagattcgggagacactttgccgaggggatgaagctgagatgatgcttgtatggaaagtttgatatttttatcagtcacatggcttttgaaaaatgatgtatatattttaaattaactattttcaataaaatatttcactc

SEQ ID NO: 2911 - DNA, 5142 bp, Homo sapiens
acactgggctccggcggccagagtgggggactaggtgaagcggcgccgggccggggctggccgggaccaggcccgaggctgagcggcggcgacagcggtggccgggaggggggaggagaggcgcagccagaggagccgccgcagtagctcccccgcctcccgggctgagggcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgaggtcagtaaaattgtgtcaaatgttcctcagttggagtttctaaacctgagttccaaccctctgaatttgtcggttttagaaagaacatgtgctgggtccttctctggggttcgcaaacttgtcctcaacaacagcaaagcttcttgggagacggtccacatgatactacaggagttaccagatttggaggagctcttcctgtgccttaatgactatgaaacagtgtcttgtccttctatttgctgtcattctcttaagctactacatataacagacaataacctccaagactggactgaaatacgaaagttaggagttatgtttccttcactggataccctcgtcctggccaacaatcatttgaatgctattgaggagcctgatgattcattggccaggttgtttcctaatcttcgatccatcagcctccacaagtcaggtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcagtgcaaaagtagaagtccactttaacgatcaggtggaagaaatgagcattcgtctggaccaaacagtggcagaactaaagaaacagttaaaaactctagtacaattacccacaagcaacatgcttctctactattttgaccatgaagcaccctttggcccagaggaaatgaagtacagctctcgggcattgcattcctttggcattagggatggagataaaatttacgtggaatccaaaacaaaataacctctaccagccttgtgaaaaacatacacataaggacttgttgcagggcatttgtttttaatgtggttttctttaggagggagaggttgtttttgttttgttttgttctgtttaggtttgggaaggattttgtatatttttccccctggagtgagtaggggccatttttgggtgttttctaccacagattgatttggctcagccagcggaattggccacatttccagtgtatgtgccctctctaaggaaagatgacaaagaaatcaccgacttcttactgtgttcactgggatttgcctgccacttggttatcattactgttgggtgaacctgtgaagataacatgaacactgtagccccttagaagggtctcatagagaatttaaacagggtgacaaggaatcttcacaggaagggccagaacttctctctcccagttcttccttccgctaccctccctccttggcttttttggttcagttccatttttttttcattttgacatgtggtttacctaatagttttgttctgttcataattcttatttctcaacctgggtgatttttttgttctcatttctcccttttgaaataattgaaagtgttttaagcatttttaacctgattctaatctcaggtacgcagtaagaagctataactctgttagaacctcgaagagtagatgtagaatgaaaactccaggaaaacttgcagttattctggaagcaccggcagaacagtctgatctctttgtatgttactaactcacttttaatgtccctgtacattatgtcagccattactttcataacatgaaatatgtcagattccagagttcttttatttttgcttattgaatgtatttcctcatatctttctttttcattactttaaactattgggaattgaggcctgacttcataaataattcaatagagtcctggatacgtgcaccaggagagttgagaattagctcataaactatctgtggtgtgtgtggggaatgaagttgggggatgtgggggaagagcttatgactttcccacctgtgtcatccattggaagcccttgctcttgcactttgcattaaaagtgggaaacattaatcaaagggagattttattcccaggttttccctgggactttgtgatatcataattgaacagttcttttgttttacatttcaatttagttgcctcatagaagtataactgcccaatctatgagtaaagtgtaagtgtcaaaactttacaattgcctccaagtcatattttttgcagaagcacatttaaagcacttttctgtaaaagctagttccttacctgcttggaaatctttttgtttgttcttctattcctttgttaatcagatgtaatccctttctttaatgtgtatttttcttggtccaccatgtttacagatgggagacttgagagatacttagcataactggggcagaaagtgtgtaagtgaagtatttttcaaagaatgcagttattatctgattgcatttgaccttttgacctttgttacataattctacccctcctacaaatttaatttttttatgaaatttttaggtgacttgtaaattcttcatgtatgaggagttgtgtttattaatgctactttttaaattttcctgtgccatgtggcagatgtttattctcttaatgcacttcaggtttgctatctgtaaagcctttgacccaggcctactgagtcaaatctacattcagtgtaacattaaaggtggaaaccaaagggtttgagaaagacgaataaggcctattctccttctgctgcagactttatctttcaaaatcataaaaatgagcaatggagatccaggctgggtatagacaagaataattattttgcaaacacattttcctgacagatttttggaagtaggaaaaaagtatggcaacagtgtcatgaagattgaaactgtaggtgctttgtgtatgtatgcatgagtgcagatgagtttgagagagaaaaagtgtaattgagccctttgcttttgtcagcctgggaaacagatgcgttcttattttttgaagttgtgtgaccctggactgtcccacagcagaaggcagaacaaacacttatgttatgctttaatcataagtggaatggtcacaattaataagatattttatatatggcaaagttttatgaaatgcttttttactattagagacctgtttcttctgttattacagaacacagtgtttatcaactgcggacataattcttttattatacagttgcatgtaaagggagcttctcatttaattcagcggatgtgggtatttttagggcattgtaattgatggttttaataattgctgaataatttttgattaagagaaaaatgtaatacaattactggtctgagttacagaacagaagttaatgaaaaaggctatttgagcatgtgtacttatagattcatttgggtggctgagaaaagatgctgcttttgaaataaaattggtgctgtgtagacacttgtaaccaaaattatttttataacagaactaaaagaaggagagaagaggccatggacctttgagtttacatgttatacctaattgattgtctgcagcttatctgtattttaatattgactttgtccagattcagtgagaacatagtattgacattatgaggcaaaatgctgtcatagccagtattactgatatgttgctacagacacaatgtatagaacataccttttctaaaataggaattatttccagttatgaaaaaggaaaagagtaataaagaaaaccaaatcaaaaccaagggatcctttctacatgtgggtgaacggctgctaaagccacagtagaaaccaatttttgaatttgaattgttgaaatatcctagattgctttaatggaaaaaatccagagtcacatatcttttttattatcaagtttttgcagccttttgccagcattgccataaatacgtaagaaagcagcagatagtataagcccctagttattaagacttctcagttaatattaaggccaaaatataacttgagctaggtataacagggctgaatgctacagtgttgtttttaaagattttgcttatttttaaagacaggaaaattcagttctaaccagatgttccagctatgttactcaaccagcagtggtaggagcagagagcacttgcactaagagctgatcaccatttgagatacgcggcttaacgcacatgtgagtgtagcttgctacatgaaaatgctaggctctagggcatgtaaaacatgaatacagaatactagattgttctaagtaatgtcatttcggtttgtgaatttgatttttcccttcatttcatgtcatattgaaaatgcaaacaaactgctctcaagaacacccagaagctatctgtgttaccagatgtgttgtgaacactctactatttttcataggtgcttccttgaaatatatgtccattgtagtggtggagagggactggactctctcaggctctttacttgccagttgtctcccgcagttaatggaaatatatatacatatatatatatattttatttagaatataatttaaacatgaaggtctattctttgcactttttattaatatatatatagataatctttaaaaaaattaaaattcaagtccatttt

SEQ ID NO: 2912 - DNA, 604 bp, Homo sapiens
attttgggggtggttggaggcggtggcggcggcggcgaggaggggaatttccttgtgcctccattcccgggaggggggagcggcgttggaggccaccgtttccagagtttcactctgtcacccaggctcgagtgcagtggcgtgttctcggctcactacaacctccgtcctctgggctcaagcagtcctcgcatctcagcctcccaaggagctgggacctcagcatcaacaacagcaacttgtgattggcggtgaccggatattcagttgcacatccccacatcaatgcactgccaatgggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgt

SEQ ID NO: 2913 - DNA, 461 bp, Homo sapiens
accctctcttgggacctgtcataagtcggaccccgggcgcccggctgcgcagtcccagccgccttccccaggcagtggaaccttcgggctcctgagcttcaggatggttcgtactaagacatggaccctgaagaagcactttgttggctatcctactaatagtgactttgagttgaagacagctgagctcccacccttaaaaaatggagaggtcctgcttgaagctttgttcctcaccgtggatccctacatgagagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccaggcctgactgcctactttggcctacttgaaatctgtggtg

SEQ ID NO: 2914 - DNA, 24030 bp, Homo sapiens
gctgcccagagcccccatagagagaggtccccgccgccaccctcatggatcagccacagttcagcggggcgccccgctttctcacccggcccaaggccttcgtggtgtcggtgggcaaggacgccaccctcagctgccagatcgtgggtaatcccacgccacaggtgagctgggagaaggaccagcagccggtggcggccggcgcgcgcttccgtctggcccaggacggcgacctctaccgcctcactatcctggacctggcgctgggcgacagtgggcaatacgtgtgccgcgcgcgcaatgccataggcgaggccttcgctgctgtgggcctgcaggtggacgcggaggccgcgtgcgccgagcaggcgccgcacttcctgctgcggcccacgtccatccgcgtgcgcgagggctcagaggccaccttccgctgccgcgtgggtggctccccgaggccggcagtgagctggtccaaggacgggcggcgcctgggtgagcccgacggcccccgcgtgcgcgtggaggagctcggcgaggcaagtgcgctgcgcattcgggcggcgcggccgcgcgacggcggcacttacgaggtccgcgccgagaacccgctgggcgctgccagcgccgccgcggcgctagtggtggactcggacgccgcggacacggccagccggcccgggacctccacggccgcgctcctggcgcacctgcagcggcggcgcgaggctatgcgcgccgagggcgcccccgcctcaccgcccagcaccggcacgcgcacctgcacggtgactgaaggcaagcacgcgcgcctcagctgctacgtgaccggcgagcccaagcccgagacggtgtggaagaaggacggccagctggtgaccgagggccggcgccacgtggtgtacgaggacgcgcaggagaacttcgtgctcaagatcctcttctgcaagcagtcggaccgcggcctctacacctgcacggcgtccaacctcgtgggccagacctacagctctgtgctggtcgtagtgcgcgagcccgcggttcccttcaaaaagcggctgcaagatctggaggtgcgggagaaggagtcggccacgttcctatgtgaggtgccccagccgtccactgaggccgcgtggttcaaggaggagacgcggttgtgggcgagcgccaagtacggcatcgaggaggagggcaccgagcgccgcctgaccgtgcgcaatgtctcggccgacgacgacgcggtgtacatctgcgagacgccagagggcagccgcacggtggcggagctcgcagtccaaggaaacctcctccgaaagctccctcggaagacggcggtgcgcgtgggcgacacggctatgttttgcgtggagctggcggtcccggtgggccccgtccactggctgcggaaccaggaggaagtggtggcggggggccgcgtggccatctccgcggagggcacgcgccacacactaaccatctcccagtgctgcctggaggatgtgggccaggtggcctttatggctggcgactgccagacgtccacccagttctgcgtgtcggcccccaggaagcctcccctgcaaccccctgtggatcctgtggtaaaggccaggatggagagttccgtgattctcagctggtccccaccaccccatggggaacgccctgtcactatcgacggctacctggtagagaagaagaagcttggcacctacacctggatcaggtgccacgaggctgaatgggtggctacacctgagctgaccgtggctgatgtggcggaggaggggaacttccagttccgagtgtccgctctcaacagctttggtcagagtccctacctcgagttcccggggactgtccacctggcccccaagctggccgtgaggacaccgctgaaggcggtgcaggcggtagagggtggcgaggtcactttctccgtggacctcacggtggcctcagcgggtgagtggttcctggatgggcaggccctgaaggccagcagtgtgtatgagatccactgtgatcgcacccggcacacgctcaccatccgggaggtgcccgccagcctgcacggggcgcagctgaagttcgtggccaacggcattgagagcagcatccggatggaggtccgggcggccccagggctgactgccaacaagccgccagccgcagctgcccgggaggtgctggctcggctgcacgaggaggcgcagctgctggctgagctgtcagatcaggctgcggctgtgacgtggctgaaggatggtcgcacactgtccccaggccccaagtatgaggtgcaggcatcggccgggcggcgggtgctccttgtgcgagatgtggcccgggacgatgcaggcctctacgagtgcgtcagccgcgggggccgcatcgcctaccagctctccgtgcaaggcctcgcgcgctttctgcacaaggacatggcgggcagctgtgtggatgccgtggctgggggcccggcgcagtttgagtgtgagacctccgaagcccacgtccacgtgcactggtacaaggatggcatggagctgggccactccggtgagcgcttcttgcaggaggatgtggggacgcggcaccggctggtggcagccacagtcaccaggcaggatgaaggcacctactcctgccgcgtgggcgaggactctgtggacttccggctccgcgtctctgagcccaaggtggtgtttgctaaggagcagctggcacgcaggaagctgcaggcagaggcaggagccagtgccacactgagctgcgaggtggcccaggcccagacggaggtgacgtggtacaaggatgggaagaagctgagctccagctcgaaagtgtgcatggaggccacaggctgcacgcgcaggctggttgtgcagcaggcaggccaggcggatgccggggagtatagctgcgaggctgggggccagcggctctccttccatctggatgtcaaagagcccaaggtggtgtttgccaaggaccaggtggcacacagtgaggtgcaggctgaggcaggggccagtgccacgctgagctgcgaggtggcccaggcccagacggaggtgatgtggtacaaagatgggaagaagctgagctccagcttgaaagtgcatgtagaggccaagggctgcagacggaggctggtggtgcagcaggcaggcaagacagatgccggggactacagctgcgaggccaggggccagagggtctccttccgcctgcacatcacagagcccaagatgatgtttgcaaaggagcagtcagtgcataatgaggtgcaggctgaggcgggggccagtgccatgctgagctgtgaggtggcccaggcccagacggaggtgacgtggtacaaggatgggaagaagctgagctccagctcaaaagtgggcatggaggtcaaagggtgcacacggaggctggtgctgccacaggcgggcaaagcagatgctggggagtacagctgtgaggctgggggccagagagtctccttccacctgcacatcacagagcccaagggggtgtttgcgaaggagcagtcagtgcataatgaggtgcaggctgaggcggggaccactgccatgctgagctgtgaggtggcccagccccagacagaggtgacgtggtacaaggacgggaagaagctgagctccagctcaaaagtacgcatggaggtcaagggctgcacacgaaggctggtagtgcagcaggtgggcaaagcagatgctggggagtacagctgcgaggctgggggccagagagtctcctttcaactgcacatcacagagcccaaggcagtgtttgccaaggagcagttggtgcataatgaggtgcggactgaggcaggggccagtgccacactgagctgtgaggtggcccaggcccagacagaggtgacgtggtacaaggatgggaagaagctgagctccagttcgaaagtgcgcatagaggctgcgggctgcatgcggcagctggtggtgcagcaggcaggccaggcagatgctggggagtacacctgtgaggctgggggccagcggctctccttccacctggatgtttcagagcccaaggcggtgtttgcaaaggagcagctggcacacaggaaggtgcaggccgaggcgggggccattgccacgctgagctgcgaggtggcccaggcccagacagaggtgacgtggtacaaggacgggaagaagctgagctccagctcgaaagttcgaatggaggctgtgggctgcacacggaggctggtggtgcagcaggcatgccaggcggacaccggggagtatagctgcgaggccgggggccagcggctctccttcagcctggacgtggcagagcccaaggtggtgtttgccaaggagcagccagtgcacagggaggtgcaggcccaggcgggggccagcaccacactcagctgcgaggtggctcaggcccagacggaggtgatgtggtacaaggacgggaagaagctgagcttcagctcgaaagtgcgcatggaggctgtgggctgcacacggaggctggtggtgcagcaggcgggccaggcggtcgccggggagtacagctgcgaggcggggagccagcggctctccttccacctgcacgtggcagagcccaaggcggtgtttgccaaggagcagccagcgagcagggaggtgcaggctgaggcggggaccagtgccacgctgagctgcgaggtggcccaggcccagacagaggtgacgtggtacaaggacgggaagaaactgagctccagctcgaaagtgcgaatggaggccgtgggctgcacacggaggctggtggtgcaggaggcaggccaggcggacgccggggagtacagctgcaaggccggggatcagcggctgtccttccacctgcacgtggcagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcagaggccggggagtacagctgcgaggcagggggtcagcagctctccttccgcctgcaggtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcttcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacagctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcagggccccacagccagtgttccgggagccgctgcagagtctgcaggcggaggagggctccacggccaccctgcagtgtgagctgtctgagcccactgctacagtggtctggagcaagggtggcctgcagctgcaggccaatgggcgccgggagccacggcttcagggctgcaccgcggagctggtgttacaggacctacaacgtgaagacactggcgaatacacttgcacctgtggctcccaggccaccagtgccaccctcactgtcacagctgcgcctgtgcggttcctccgagagctgcagcaccaggaggtggatgagggaggcaccgcacacttatgctgcgagctgagccgggcgggtgcgagcgtggagtggcgcaagggctccctacagctcttcccttgtgccaagtaccagatggtgcaggatggtgcagctgcagagctgctggtacgcggagtggagcaggaggatgcgggtgactacacgtgtgacacgggccacacgcagagcatggccagcctctctgtccgtgtccccaggcccaagttcaagacccggcttcagagtctggagcaggagacaggtgacatagcccggctgtgctgtcagctgagtgatgcagagtcgggggccgtggtgcaatggctcaaggagggcgtggagctgcatgcgggccccaagtacgagatgcggagccagggggccacgcgggagctgctgatccaccaactggaggccaaggacacgggcgagtatgcctgtgtgacaggcggccagaaaaccgctgcctccctcagggtcacagagcctgaggtgaccattgtacgggggctggttgatgcggaggtgacggccgatgaggatgttgagttcagctgtgaggtgtccagggctggagccacaggcgtgcagtggtgcctacagggcctgccactgcaaagcaatgaggtgacagaggtggctgtgcgggatggccgcatccacaccctgcggctgaagggcgtgacgcccgaggacgctggcactgtctccttccatttgggaaaccatgcttcctctgcccagctcaccgtcagagctcctgaggtgaccatcctggagcccctgcaggacgtgcagctcagtgagggccaggatgccagcttccagtgccggctatccagagcttcaggccaggaggcccgctgggctttaggaggggtgcccctgcaggccaacgagatgaatgacatcactgtggagcagggcacactccacctgctcaccctgcacaaggtgacccttgaggatgctggaactgtcagtttccacgtgggcacgtgtagctctgaggcccagctgaaagtcacagccaagaacacggtggtgcgggggctggagaatgtggaggcgctggagggcggcgaggcgctgttcgagtgccagctgtcccagcccgaggtggccgcccacacctggctgctggacgacgaacccgtgcacacctcggagaacgccgaggtggtcttcttcgagaacggcctgcgccacctgctgctgctcaaaaacttgcggccacaagacagctgccgggtgaccttcctggctggggatatggtgacgtccgcattcctcacggtccgaggctggcgcctggagatcctggagcctctgaaaaacgcggcggtccgggccggcgcacaggcatgcttcacctgcacgctcagcgaggcggtgcccgtgggagaggcgtcctggtacatcaatggcgcggcagtgcagccggatgacagcgactggactgtcaccgccgacggcagtcaccacgccctactgctgcgcagcgcccagccccaccacgccggggaggtcaccttcgcttgccgcgacgccgtggcctctgcgcggctcaccgtgctgggcctccctgatcccccagaggatgctgaggtggtggctcgcagcagccacactgtgacactgtcttgggcagctcccatgagtgatggaggcggtggtctctgtggctaccgcgtggaggtgaaggagggggccacaggccagtggcggctgtgccacgagctggtgcctggacccgagtgtgtggtggatggcctggcccccggggagacctaccgcttccgtgtggcagctgtgggccctgtgggtgctggggaaccggttcacctgccccagacagtgcggcttgcagagccaccgaagcctgtgcctccccagccctcagcccctgagagccggcaggtggcagctggtgaagatgtctctctggagcttgaggtggtggctgaggctggtgaggtcatctggcacaagggaatggagcgcatccagcccggtgggcggttcgaggtggtctcccagggtcggcaacagatgctggtgatcaagggcttcacggcagaagaccagggcgagtaccactgtggcctggctcagggctccatctgccctgcggctgccaccttccaggtggcactgagcccagcctctgtggatgaggcccctcagcccagcttgccccccgaggcagcccaggagggtgacctgcacctactgtgggaggccctggctcggaaacgtcgcatgagccgtgagcccacgctggactccattagcgagctgccagaggaggacggccgctcgcagcgcctgccacaggaggcagaggaggtggcacctgatctctctgaaggctactccacggccgatgagctggcccgcactggagatgctgacctctcacacaccagctctgatgatgagtcccgggcaggcaccccttccctggtcacctacctcaagaaggctgggaggccaggcacctcaccactggccagcaaggttggggccccagcagccccctctgtgaagccacagcagcagcaggagccactggctgctgtgcgcccaccactgggagacctgagcaccaaagacctgggtgatccctcaatggacaaggcagctgtgaagatccaggctgcctttaagggctacaaggtccggaaggagatgaagcagcaggaagggcccatgttctcccacacatttggggacaccgaggcacaggtgggggatgccctgcggctggagtgtgtcgtggccagcaaggcagatgtgcgagcccgctggctgaaggatggtgtggagctgaccgatgggcggcaccatcacatcgaccagcttggggatggcacctgctctctgctgatcactggcctggaccgtgctgatgctggctgctacacctgtcaggtgagcaacaagtttggccaggtgacccacagtgcctgtgtggtggtcagtgggtcagagagtgaagccgagagctcctctgggggtgagctggacgatgccttccgccgggctgcccgtcggctgcaccggctcttccgcaccaaaagtccggctgaagtttcagatgaggagctcttcctgagtgcagacgagggccctgcagagccagaggagcccgcggactggcagacataccgcgaagatgagcatttcatctgcatccgttttgaggcgctcactgaggcccgccaggcggtaactcgcttccaggagatgtttgccacactgggcattggggtggagatcaagctggtggaacaggggcctcggagggtagagatgtgcatcagcaaagagactcctgcccctgtggtgcctccagagccattgcccagcctactgacttctgacgctgccccagtgttcctgactgagttgcagaaccaagaagtgcaggatgggtatcctgtgagctttgactgcgtggtgacaggtcagcccatgcccagtgtgcgctggttcaaggatgggaagttgttggaggaggatgatcactacatgattaatgaagaccaacagggtggccatcagctcatcatcacagccgtggtgccagcagacatgggcgtctaccgctgcctggccgagaacagcatgggtgtctcctccaccaaggctgagctccgtgtggacttgacaagcacagactatgacactgcagcagatgccacggagtcctcatcctacttcagtgcccaaggctacctgtccagccgggagcaggagggaacagagtccaccactgatgagggccagctgccccaggtggtggaggagctgagagacctccaggtggcccctggcacacgcctggccaagttccagctcaaggtgaaaggctaccctgctcccagattatactggttcaaagatggccagcccctgaccgcatctgcccacatccgcatgactgacaagaagatcctgcacaccctggagatcatctccgtcacccgggaggactctggccagtatgcagcctatatcagcaatgccatgggtgctgcctactcgtctgcccggctgctggttcgaggccctgatgagccagaagagaagcctgcatcagatgtgcatgagcagctggtgccgccccgaatgctggagaggttcacccccaagaaagtgaagaaaggctccagcatcaccttctctgtgaaggtagaaggacgcccggtgcccaccgtgcactggctcagggaggaggctgagagaggcgtgctgtggattggccctgacacaccgggctacaccgtggccagctctgcgcagcagcacagcctggtcctgctggacgtgggccggcagcaccagggcacctacacatgcattgccagcaacgctgccggccaggccctctgctccgccagcctgcacgtctcgggcctgcctaaggtggaggagcaggagaaagtgaaggaagcgctgatttccactttcctgcaggggaccacacaagccatctcagcacaggggttggaaactgcgagttttgctgaccttggtgggcagaggaaagaagagcctctggctgccaaggaggccctcggccacctgtccctcgctgaggtgggcacagaggagttcctgcagaaactgacctcccagatcactgagatggtatcggccaagatcacgcaggccaagctgcaggtgcccggaggtgacagtgatgaggactccaagacaccatctgcatccccccgccatggccgatcacggccatcctccagcatccaggagtcttcctcagagtcagaggacggcgatgcccgaggcgagatctttgacatctacgtggtcaccgctgactacctgcccctaggggctgagcaggatgccatcacgctgcgggaaggccagtatgtggaggtcctggatgcagcccacccactgcgctggcttgtccgcaccaagcccaccaagtccagcccctcacggcagggctgggtgtcaccagcctacctggacaggaggctcaagctgtcacctgagtggggggccgctgaggcccctgagttccctggggaggctgtgtctgaagacgaatacaaggcaaggctgagctctgtgatccaggagctgctgagttctgagcaggccttcgtggaggagctgcagttcctgcagagccaccacctgcagcacctggagcgctgcccccacgtgcccatagctgtggccggccagaaggcagtcatcttccgcaatgtgcgggacatcggccgcttccacagcagcttcctgcaggagttgcagcagtgcgacacggacgacgacgtggccatgtgcttcatcaagaaccaggcggcctttgagcagtacctggagttcctggtggggcgtgtgcaggctgagtcggtggtcgtcagcacggccatccaggagttctacaagaaatacgcggaggaggccctgttggcaggggacccctctcagcccccgccaccacctctgcagcactacctggagcagccagtggagcgggtgcagcgctaccaggccttgctgaaggagctgatccgcaacaaggcgcggaacagacagaactgcgcgctgctggagcaggcctatgccgtggtgtctgccctgccacagcgcgctgagaacaagctgcacgtgtccctcatggagaactacccaggcaccctgcaggccctgggcgagcccatccgccagggccacttcatcgtgtgggagggtgcaccgggggcccgcatgccctggaagggccacaaccgtcacgtgttcctcttccgcaaccacctggtaatctgcaagccccggcgagactcccgcaccgataccgtcagctacgtgttccggaacatgatgaagctgagcagcatcgacctgaacgaccaggtggagggggatgaccgcgccttcgaggtgtggcaggagcgggaggactcggtgcgcaagtacctgctgcaggcacggacagccattatcaagagctcgtgggtgaaggagatctgtggcatccagcagcgtctggccctgcctgtgtggcggcccccggactttgaagaggagctggccgactgcacagccgagctgggtgagacagtcaagctggcctgccgcgtgacgggcacacccaagcctgtcatcagctggtacaaagatgggaaagcagtgcaggtggacccccaccacatcctcattgaagaccctgatggctcgtgtgcactcatcctggacagcctgaccggtgtggactctggccagtacatgtgcttcgcggccagcgccgctggcaactgcagtaccctgggcaagatcctggtgcaagtcccaccacggttcgtgaacaaggtccgggcctcaccctttgtggagggagaggacgcccagttcacctgcaccatcgaaggcgccccgtacccgcagatcaggtggtacaaggacggggccctgctgaccactggcaacaagttccagacactgagtgagcctcgcagcggcctgctagtgctggtgatccgggcggccagcaaggaggacctggggctctacgagtgtgagctggtgaaccggctgggctccgcgcgggctagtgcggagctgcgcattcagagccccatgctgcaggcccaggagcagtgtcacagggagcagctcgtggctgcagtggaagacaccaccctggagcgagcggaccaggaggtcacatctgtcctgaagagactgctgggccccaaggcgccaggcccctccacaggggacctcactggccctggcccctgccccaggggggcacccgcactccaggaaaccggctcccagcccccagtcaccggaacttcggaggcacctgccgtgcccccgagggtgccacagcccctcctccacgaaggcccagagcaggagccggaggccattgccagagcccaggaatggactgtgcccattcggatggagggtgcagcctggcccggggcaggcacaggggagctgctctgggacgtccacagccacgtggtcagagagaccacacagaggacctacacataccaggccatcgacacgcacaccgcacggcccccatccatgcaggtaaccatcgaggatgtgcaggcacagacaggcggaacggcccaattcgaggctatcattgagggcgacccacagccctcggtgacctggtacaaggacagcgtccagctggtggacagcacccggcttagccagcagcaagaaggcaccacatactccctggtgctgaggcatgtggcctcgaaggatgccggcgtttacacctgcctggcccaaaacactggtggccaggtgctctgcaaggcagagctgctggtgcttgggggggacaatgagccggactcagagaagcaaagccaccggaggaagctgcactccttctatgaggtcaaggaggagattggaaggggcgtgtttggcttcgtaaaaagagtgcagcacaaaggaaacaagatcttgtgcgctgccaagttcatccccctacggagcagaactcgggcccaggcatacagggagcgagacatcctggccgcgctgagccacccgctggtcacggggctgctggaccagtttgagacccgcaagaccctcatcctcatcctggagctgtgctcatccgaggagctgctggaccgcctgtacaggaagggcgtggtgacggaggccgaggtcaaggtctacatccagcagctggtggaggggctgcactacctgcacagccatggcgttctccacctggacataaagccctctaacatcctgatggtgcatcctgcccgggaagacattaaaatctgcgactttggctttgcccagaacatcaccccagcagagctgcagttcagccagtacggctcccctgagttcgtctcccccgagatcatccagcagaaccctgtgagcgaagcctccgacatttgggccatgggtgtcatctcctacctcagcctgacctgctcatccccatttgccggcgagagtgaccgtgccaccctcctgaacgtcctggaggggcgcgtgtcatggagcagccccatggctgcccacctcagcgaagacgccaaagacttcatcaaggctacgctgcagagagcccctcaggcccggcctagtgcggcccagtgcctctcccacccctggttcctgaaatccatgcctgcggaggaggcccacttcatcaacaccaagcagctcaagttcctcctggcccgaagtcgctggcagcgttccctgatgagctacaagtccatcctggtgatgcgctccatccctgagctgctgcggggcccacccgacagcccctccctcggcgtagcccggcacctctgcagggacactggtggctcctccagttcctcctcctcctctgacaacgagctcgccccatttgcccgggctaagtcactgccaccctccccggtgacacactcaccactgctgcacccccggggcttcctgcggccctcggccagcctgcctgaggaagccgaggccagtgagcgctccaccgaggccccagctccgcctgcatctcccgagggtgccgggccaccggccgcccagggctgcgtgccccggcacagcgtcatccgcagcctgttctaccaccaggcgggtgagagccctgagcacggggccctggccccggggagcaggcggcacccggcccggcggcggcacctgctgaagggcgggtacattgcgggggcgctgccaggcctgcgcgagccactgatggagcaccgcgtgctggaggaggaggccgccagggaggagcaggccaccctcctggccaaagccccctcattcgagactgccctccggctgcctgcctctggcacccacttggcccctggccacagccactccctggaacatgactctccgagcaccccccgcccctcctcggaggcctgcggtgaggcacagcgactgccttcagccccctccgggggggcccctatcagggacatggggcaccctcagggctccaagcagcttccatccactggtggccacccaggcactgctcagccagagaggccatccccggacagcccttgggggcagccagcccctttctgccaccccaagcagggttctgccccccaggagggctgcagcccccacccagcagttgccccatgccctcctggctccttccctccaggatcttgcaaagaggcccccttagtaccctcaagccccttcttgggacagccccaggcaccccctgcccctgccaaagcaagccccccattggactctaagatggggcctggagacatctctcttcctgggaggccaaaacccggcccctgcagttccccagggtcagcctcccaggcgagctcttcccaagtgagctccctcagggtgggctcctcccaggtgggcacagagcctggcccctccctggatgcggagggctggacccaggaggctgaggatctgtccgactccacacccaccttgcagcggcctcaggaacaggcgaccatgcgcaagttctccctgggtggtcgcgggggctacgcaggcgtggctggctatggcacctttgcctttggtggagatgcagggggcatgctggggcaggggcccatgtgggccaggatagcctgggctgtgtcccagtcagaggaggaggagcaggaggaggccagggctgagtcccagtcggaggagcagcaggaggccagggctgagagcccactgccccaggtcagtgcaaggcctgtgcctgaggtcggcagggctcccaccaggagctctccagagcccaccccatgggaggacatcgggcaggtctccctggtgcagatccgggacctgtcaggtgatgcggaggcggccgacacaatatccctggacatttccgaggtggaccccgcctacctcaacctctcagacctgtacgatatcaagtacctcccattcgagtttatgatcttcaggaaagtccccaagtccgctcagccagagccgccctcccccatggctgaggaggagctggccgagttcccggagcccacgtggccctggccaggtgaactgggcccccacgcaggcctggagatcacagaggagtcagaggatgtggacgcgctgctggcagaggctgccgtgggcaggaagcgcaagtggtcctcgccgtcacgcagcctcttccacttccctgggaggcacctgccgctggatgagcctgcagagctggggctgcgtgagagagtgaaggcctccgtggagcacatctcccggatcctgaagggcaggccggaaggtctggagaaggaggggccccccaggaagaagccaggccttgcttccttccggctctcaggtctgaagagctgggaccgagcgccgacattcctaagggagctctcagatgagactgtggtcctgggccagtcagtgacactggcctgccaggtgtcagcccagccagctgcccaggccacctggagcaaagacggagcccccctggagagcagcagccgtgtcctcatctctgccaccctcaagaacttccagcttctgaccatcctggtggtggtggctgaggacctgggtgtgtacacctgcagcgtgagcaatgcgctggggacagtgaccaccacgggcgtcctccggaaggcagagcgcccctcatcttcgccatgcccggatatcggggaggtgtacgcggatggggtgctgctggtctggaagcccgtggaatcctacggccctgtgacctacattgtgcagtgcagcctagaaggcggcagctggaccacactggcctccgacatctttgactgctgctacctgaccagcaagctctcccggggtggcacctacaccttccgcacggcatgtgtcagcaaggcaggaatgggtccctacagcagcccctcggagcaagtcctcctgggagggcccagccacctggcctctgaggaggagagccaggggcggtcagcccaacccctgcccagcacaaagaccttcgcattccagacacagatccagaggggccgcttcagcgtggtgcggcaatgctgggagaaggccagcgggcgggcgctggccgccaagatcatcccctaccaccccaaggacaagacagcagtgctgcgcgaatacgaggccctcaagggcctgcgccacccgcacctggcccagctgcacgcagcctacctcagcccccggcacctggtgctcatcttggagctgtgctctgggcccgagctgctcccctgcctggccgagagggcctcctactcagaatccgaggtgaaggactacctgtggcagatgttgagtgccacccagtacctgcacaaccagcacatcctgcacctggacctgaggtccgagaacatgatcatcaccgaatacaacctgctcaaggtcgtggacctgggcaatgcacagagcctcagccaggagaaggtgctgccctcagacaagttcaaggactacctagagaccatggctccagagctcctggagggccagggggctgttccacagacagacatctgggccatcggtgtgacagccttcatcatgctgagcgccgagtacccggtgagcagcgagggtgcacgcgacctgcagagaggactgcgcaaggggctggtccggctgagccgctgctacgcggggctgtccgggggcgccgtggccttcctgcgcagcactctgtgcgcccagccctggggccggccctgcgcgtccagctgcctgcagtgcccgtggctaacagaggagggcccggcctgttcgcggcccgcgcccgtgaccttccctaccgcgcggctgcgcgtcttcgtgcgcaatcgcgagaagagacgcgcgctgctgtacaagaggcacaacctggcccaggtgcgctgagggtcgccccggccacacccttggtctccccgctgggggtcgctgcagacgcgccaataaaaacgcacagccgggcgag

SEQ ID NO: 2915 - DNA, 972 bp, Homo sapiens
gcggcggcggcagcggcagcggcagcggcgctgagttttgtctcccgggccgtctgggcgcgcgcgggtgtcccaggtaccccgccgcctccctccttcccgcaggactcgtccctcctggccctgggccccaacggtgcccgcctgcccggcggtcggtcagcgcacagggcacggcttcctctgcttctcccggaccacttagtctcaacccggaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaag

SEQ ID NO: 2916 - DNA, 661 bp, Homo sapiens
atgcaagcttgctgtggaaagcatgcttcccgtctgtcagggcttcctgagaggagacctggtgacacagtagcctttcggcagagctccttgggatgagtaggaagtgctgctgcaggttttgtctgggggatatctgagccatttctctgtgggcagctgtgtttcaaagtctgggcaggttgttgttgaattttgcgtgggctgccaggattttgtggaagtataatactttgtcattatgagatgtcgtctctcggtgcctcctttgtgcaaattaaatttgatgacttgcagttttttgaaaactgcggtggaggaagttttgggagtgtttatcgagccaaatggatatcacaggacaaggaggtggctgtaaagaagctcctcaaaatagagaaagaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacg

SEQ ID NO: 2917 - DNA, 1558 bp, Homo sapiens
gtccgctgtccggcctccggtcacgtgacagcagcgcaggtgagcgccgcttccggggtcgggcgcctggatagctgccggctccggcttccacttggtcggttgcgcgggagactatggcgtcctcctcggtcccaccagccacggtatcggcggcgacagcaggccccggcccaggtttcggcttcgcctccaagaccaagaagaagcatttcgtgcagcagaaggtgaaggtgttccgggcggccgacccgctggtgggtgtgttcctgtggggcgtagcccactcgatcaatgagctcagccaggtgcctcccccggtgatgctgctgccagatgactttaaggccagctccaagatcaaggtcaacaatcaccttttccacagggaaaatctgcccagtcatttcaagttcaaggagtattgtccccaggtcttcaggaacctccgtgatcgatttggcattgatgaccaagattacttgtacattgtgaagtgccatggcaacacgcttctgccccagttcctggggatgtaccgagtcagtgtggacaacgaagacagctacatgcttgtgatgcgcaatatgtttagccaccgtcttcctgtgcacaggaagtatgacctcaagggttccctagtgtcccgggaagccagcgataaggaaaaggttaaagaattgcccacccttaaggatatggactttctcaacaagaaccagaaagtatatattggtgaagaggagaagaaaatatttctggagaagctgaagagagatgtggagtttctagtgcagctgaagatcatggactacagccttctgctaggcatccacgacatcattcggggctctgaaccagaggaggaagcgcccgtgcgggaggatgagtcagaggtggatggggactgcagcctgactggacctcctgctcttgtgggctcctatggcacctccccagagggtatcggaggctacatccattcccatcggcccctgggcccaggagagtttgagtccttcattgatgtctatgccatccggagtgctgaaggagccccccagaaggaggtctacttcatgggcctcattgatatccttacacagtatgatgctaagaagaaagcagctcatgcagccaaaactgtcaagcatggggctggggcagagatctctactgtccatccggagcagtatgctaagcgattcctggattttattaccaacatctttgcctaagagactgcctggttctctctgatgttcaaggtggtggggttctgagacacttgggggaattgtggggatattctagccaccagttctcttcttcctttgctaaattcaggctgcaggctccttccatccagataactccatcctgtcgagtaggctctttctgaccctcagaaatacattgtcctttttcctctttgcccatttttcttccctctcttcctccccatgagaagtctgcttgtagtattagaatgttattgttgactctctcccaagtgccttgatctttgtaatatctcctgttgtttctatgatatagg

SEQ ID NO: 2918 - DNA, 793 bp, Homo sapiens
gaagccgttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggatttccaatttccaagcctgatgggatctcccagctggaacaggatctacaggtctttgatctggaaactaagactagagaagtcttaagagatgactgctcagatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatc

SEQ ID NO: 2919 - DNA, 2696 bp, Homo sapiens
agttgcaacttgtctttgagtgcagggacaggagaagtgtgggctacccggccactgccctggagctgtggtgactgctgcgtttttctcccatgcacttgcacgtccaggactcctgggagaacttgggccacactccttccttgccctcttgagctcattcgtcaccctgttgggtgagcacagccctagctcaggccactgggcaagccacaccatccaaagaggaggtcctctgccccaggacccccacaccaccccaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagaacatgcccaatgtccgtgatcatgatgcctctgtctacctccgcctccaaggggatgccttgtctgtgggtggctatgaggccaaccccatcttttgggaggaggtgtcagacaagtttgccttcggcctctttgacctggactgggaggtgttcacccagcacattgaaggcgccatcaacagggtccccgtgctggagaagacaggaatcaagtccacggtctgcggccctgaatccttcacgcccgaccacaagcccctgatgggggaggcacctgagctccgagggttcttcctgggctgtggcttcaacagcgcaggaatgatgctgggtggtggctgtgggcaggagctggcccactggatcatccatgggcgcccggagaaggacatgcatggctatgacatcaggcgcttccatcactcgctcacggaccacccccgctggatccgagagcgaagccatgagtcctacgccaagaactactccgtcgtcttcccccacgatgagccgctggccgggcgcaacatgaggagagacccgctgcacgaggaactccttggacaaggctgcgtgttccaggagcggcatggctgggagcgaccgggatggtttcatccccgaggcccagctccggtcctcgagtacgactactacggggcttacgggagccgcgcgcacgaggactacgcctaccgcaggctgctggcagacgagtacaccttcgccttcccgccccaccacgacacgatcaagaaggagtgcctggcctgcagaggggccgccgctgtgtttgacatgtcctacttcgggaagttctacctggtggggctggatgcaaggaaggctgccgactggctcttctccgcagatgtcagccgacccccaggctccaccgtgtacacgtgcatgctcaaccaccgtgggggcaccgagagtgacctgactgtcagccgcctggcacccagccaccaggcctccccgctggcccccgcctttgaaggggacggttactacctggccatgggcggggccgtggcccagcacaactggtcccacatcaccaccgtgctgcaggaccagaagtcccagtgccagctcatcgacagctccgaggacctgggtatgatcagtatccagggcccagccagccgagccattttgcaggaggtgctggacgcagacctgagcaacgaggccttcccgttctccacccacaagctactgagagccgcagggcacctggtccgagccatgcggctgtcctttgtgggggagctgggctgggagctgcacattccaaaggcgtcctgcgtgcctgtgtaccgggctgtgatggccgcgggtgccaagcacggcctcatcaacgcagggtaccgcgccatcgactccctgagcattgagaaaggctaccggcactggcacgcggacctgcggccagacgacagccccctggaggcaggcctggccttcacctgcaagctcaagtcgccggtgcccttcctggggagggaggccctggagcagcagcgggccgcaggcctccgccggcgcctggtgtgcttcaccatggaggacaaagtacccatgtttggcctggaggccatctggaggaacggccaagtggtgggccatgtccggagggctgactttgggttcgccatcgacaagaccatcgcctacggttacatccatgaccccagcggtgggccggtctcgctggactttgtgaagagcggggactatgccctggagagaatgggggtgacctatggtgcccaggctcacctgaagtcgcccttcgaccccaacaacaagagggtgaagggaatctactgagggctca

SEQ ID NO: 2920 - DNA, 664 bp, Homo sapiens
actttgatgagcaaggaacgctgttttagaaaatccttactacttgatgattaatccttggagctaatgttccacgttcccaaggttgtgagtgcttatggccacattcctgcatcagctcagccatcgcggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagctcgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggta

SEQ ID NO: 2921 - DNA, 3250 bp, Homo sapiens
gagtcaggaatggagagaagggtaatggttttacctcttattgtggaaacctgttgagatcacagagaatatactgacggcataaaagggcagaaccatagcagggtgcgcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccaggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacacgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 2922 - DNA, 3905 bp, Homo sapiens
ggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatggaagacaataagcagctcgcgctccgcatcgatggggcggtccagtcggccagccaggaggtgaccaacctgcgagccgaactcacggccaccaaccggagactggcggaactgagcggcggcggcggccccggcccgggcccgggagccgcggccagcgcctcggcggcgggggactcggcggcgacgaacatggagaacccccagcttggagcgcaagtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcgccatgccgggcgagacggtgctcaatggcaaccaggagtgggtggtgcaggcggacctcccgctgaccgcagccatccggcagagtcaacagactctctaccactcacacccccctcaccctgcggaccggcaagcggtcagggtgagcccctgccactcccggcagccctctgtcatctccgacgcatctgccgccgaaggcgaccggtcgtccacaccgagcgacatcaactcccctcgacaccggacacactccctctgcaacggcgacagtcccggcccagttcagaagaacctgcacaaccctattgtacagtcactagaggatcttgaagaccaaaaacggaaaaagaagaaagagaagatgggattcggctccatctcccgcgtcttcgccagagggaagcagcggaagtccctcgaccccggcctctttgatggtaccgcccctgattattacatagaggaggacgcggactggtgatacgcgctcccctgcgcctgctgcccgcaggcgtgtctgtgcgtgtgggcgtgtgtgcaagcgagcgtgggtgcgcgtgtggccgtgcgtggggtgcgtgtgcacgtgtgcgctggcacacatgggtgctgggtgtggccgagcgcctctaacaagtgaaaacacgagtgtgaacctctctcccctgcgtcgccacctctgtaattgatgtacataccgcaaaccgtgtgtgaacctgtcaactctctgtcgtctttggagcgatacagttgtgttgttaatctggtttattatttttcttcagtgtttggtttttctttttctttttgtttggttcgtcggtttgtttttgtttttgtttttttccccctttctcctcccctcctcctttttatgaaacttgaaaacttgaaggactgctgtgtatttgtaaataacaaaactattgtgcactctgtgcttgtaaatgtccctcgtccaaaccgctactcctggagcccgtctggcagaggatgtggtctgtttttgatgtcccccctcccgcccccctggtgtgaacgtgtgggaccagaccctgtcctgggggtgcgcccaagtcactttaaccacaaaacgccatcgtcgtcagggtaagctctgctctctacaaagactcgcgagccgggccaaggggccttgtcttggctgggtttgtcagaggtcaaaccggctcttttaaacggcctaccagtttttaaattgcattgccgtttctttctttatgaaaaaaaagaaaaaaagaaaattgtttcatttaatttatttgcacaaatgctgaaaacttattctatctaaattattacataaatattggaatgtctatttttccatggggtgggcgggaggtgggtgtctctgttgacttgtctgttctgttaccatgctgctacccaactgtgcaaagtagtttagggtggccagaacccagggaccattggatttcaaagcttgctttttctgttggttcttctctctccttctctctctgtctctcccattctcctgcccatgcatgaaaggatcctccaccttcttcccacccagagctccctccaggcctttctctatatatttatttatctgacatacagaacacgactttagtgagcagagtgctgacagtcatggtccccttctttgggtctgtcttttgagagaggttgagttcagggcaagacagcctgccacacatccaagggtacgaccagtgggaccctggcctgagtctgttctccgaggggcctccagcagcttctgttcctccctgcagctgtgtctttcttgtcctgggtttaggatgcaggtgggccaggcaggtgttgttaggggaggcacccacttcaaaaggagggccacagtggggacacagagtccagcacctgagccctccaccctccccattctggttggttccatcagccacacttagaatctcccaggatcccttggactccgtcccccaacttgtcacagcagcctgagcctacccaccccaggagacaagagctggcaggaacatctgcctatatggggggtggcgttggccccaaagaggcttcaccagcaaaggaactgtgtgtattttaatgccaggggacggaggatgtgtgagctgttcagcaaggtctgcccaaggcctaaaactcaatttccttattcttttgcttctgctcgtccttaacaactaacagctcaacccacacctctagacaacagtagtcgtgctttctgctaacggtgacattttcagctcttaaaaagaagcaaggagattttcaaatgctagagtatctctatcagaaggcataggacattgtgtccaaagtctcaagaacaaacaacactttccttctgacctggtccaaaagtcagcaaacagcaagcaggcagaggccctcataaggacttttctgtcctcctttgaccaaactgtttaaccgagcctaggggtgacggggagcgacccaagctggcatctttctctacggagacagattttagaaaatacttttcttgcccatgaatttcttttctggttgatttttatcattttccctttacttacaagaaaataagattgcaaccactcctgctaatgatttagtagttccttttcatttcagtttttgtaaattaggagataattctaagagttactaaaggatgatttatttaagagaactacgtcaaatagcgaatgagttatgggtaacattagacgaaaataacctttcccgtgggaaaggtttctcgaaggcatggatgcaaatataaaatattaaaaaaaatctaaataaagcttattttaaaatatgatcg

SEQ ID NO: 2923 - DNA, 692 bp, Homo sapiens
gcgggttggagcggaagcgcacgcctgctaggatcagcggtggtggttccgcgatggtaggcggcggcggggtcggcggcggcctcctggagaatgccaaccccctcatctaccagcgctctggggagcggcctgtgacggcaggcgaggaggacgagcaggttcccgacagcatcgacgcacgcgagatcttcgatctgattcgctccatcaatgacccggagcatccactgacgctagaggagttgaacgtagtagagcaggtgcgggttcaggttagcgaccccgagagtacagtggctgtggctttcacaccaaccattccgcactgcagcatggccacccttattggtctgtccatcaaggtcaagcttctgcgctcccttcctcagcgtttcaagatggacgtgcacattactccggggacccatgcctcagagcatgcagtgaacaagcaacttgcagataaggagcgggtggcagctgccctggagaacacccacctcttggaggttgtgaatcagtgcctgtcagcccgctcctgagcctggcctttgacccctcagcctgcatactggtatcctggtcccagctcctgccagggctgttaccgttgttttcttgaatcactcacaatgagaaactaacattttgctttttgtaataaagttaatttatattcagttcccagc

SEQ ID NO: 2924 - DNA, 797 bp, Homo sapiens
ggctctttcccttagtaacagcttttaccttctgcctcaattcctctccccgctcgcgcccttcccccgcgcgccgcctccccccgccgccggccgcgtgcgcccccgcccctccccccgcggcgggagcacctccgctcgccacctggggacccgcgccgcgctccccgcccccgcccgcccggcgcccatcccccgcgccctccgctcgctggggttataattgcctctcaccccccggaggggttattttgggggtggttggaggcggtggcggcggcggcgaggaggggaatttccttgtgcctccattcccgggaggggggagcggcgttggaggccaccgtttccagcatcaacaacagcaacttgtgattggcggtgaccggatattcagttgcacatccccacatcaatgcactgccaatgatgaggaaactgaggccttggactagaacagaggtctcctgactcagtccaggactctttctattacatcatgcggcctgatatttgtctttatggaactcagcaacatcacatacaggggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgag

SEQ ID NO: 2925 - DNA, 1664 bp, Homo sapiens
gtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtggttttacctcggatagaggtttccagtttgtttcctcgtctcttccagacatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaa

SEQ ID NO: 2926 - DNA, 2098 bp, Homo sapiens
ggggaatctcacagccctcacctacctcaacctcagccgaaaccagctgtcgctgctgccaccctacatctgccagctgcccctgagggtcctcatcgtcagcaacaacaagctgggagccctgccccctgacatcggcaccctgggaagcctgcgacagcttgacgtgagcagcaacgagctccaatccctgccctcggaactgtgtggcctctcttccctgcgggacctcaatgtccggaggaaccagctcagtacgctgcccgaagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctgccctgcagaggatctatttccgggacatcggtacgatggtgggctggactcaggcttccacagcgttgatagtggcagcaagaggtggtctggaaatgagtcaacagatgaattttcagagctgtcattccggatctcagagctggcccgggagccccggggacccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcaggcgggaggagccggcaggggaggagcggcggcgcccggacaccttgcagctgtggcaggagcgggaacggcggcagcagcagcagagcggggcgtggggggccccgaggaaggatagcggctcgcctaagtccagtgcctcccaagcaggggctgcagcggggcagggagcccccgcccctgcccctgcctcccaagagccccttcccatagctggaccagcgacagcacctgctccacggccacttggctccattcagagaccaaacagcttcctcttccgttcctcctctcagagtggctcaggcccttcctcaccagactctgtcctgagacctcggcggtacccccaggttccagatgagaaggacttaatgactcagctgcgccaggtccttgagtcccggctgcagcggcccctgcctgaggacctggccaggctctggccagtggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcggctcctgggttcctaggccccaaaatcggccctccctcacccctttcccttcctctctatttataaggtccctgctccacccgaccccacctgcggtgccttcagccccaaccaaagacactagtgcacccccttcacagacactgacctcagaggccccactctggtgcccccagaccctgggcccccagcctctggcctccctccagtagccccacgagtccccacctctcagtgctgacggtgccttcatgtccccgccggccctgcccctgccctctgtaccccgtgaggggtggcaggagctggagtctcccccttcctcctgtgccctccccttccccccccaacagctgctatgggggggctaaattatctctattttgtagagaggatctatatttgtaggggttcggggcccaggccgggtccctatctctgtgtataaactgtacagaccgtg

SEQ ID NO: 2927 - DNA, 2371 bp, Homo sapiens
acctgctgggagctggaggaggcgcggagcgaagccggccctgccagccacgcggagaagcagaggcaggtgagcgcgatgcagccggcgccgggtctggggctcggggactcctccctgcaccgctacctggacggcgacttctggagcctcaagaacgagctgcgcggactcctcggcggcgcccgctcttccggcaaaggtatgatttaagcttggatgaaatgagagctttgacagttcagagagtgaagtttgccatggacctgcctctgttaaaacgtgcaggtcaggatctggcagagaaaacaaagaattttgtcagccgaagccttgtcataggagaagtcctctccatggcggacatggccacaggagtgaagtgcggaataatttattggctatttggtggtgctatcaggaatctcggaagccctgaacatgttactaagtggtttcagccactccaggagcagaaatacactgggatgtttgcaatgaccgagaggggccatgggagcaacgcgagagggatccagaccgaagccacctttgacctctctgcccaggagtttgtaattgacacgccgtgtgaaaatgcggagaagatgtatattggaaatgccatgtacgggaattatgcagctgtctttgcccagctcatcatagatggaagatctcaagggccccactgtttcatcgttcctgtccgggatgaaaacggaattgtacccaggagtcacagctattgatatgatgtacaaggagggtctgcatggtgtggacaatgggatattaatatttgacaaggttcggatacccagggagaacctgctggataagtttggttccgtggctccagatggacagtaccattcgcctattaggaacaagagtgcaagattcaatgccatgctggcagcactgaccccttcgagattagctgtggctttccaagctatgggtgccatgaagcttgggttgacgatagccattcgctatagccacagccggaggcagtttgggcccaaaaccaaggaagaggtgaagatcattgagcaccaaacacagaccctgcggctgatgccccacctggccacagccttggccctgaccttcgtcagcaggtatgctggggccctcctggatgaggatgtcttccagggaaaggagctggtcaacagtcgctcgctgcaggctctggtggcggggctgaaggcctacagcacctgggagaacatccgctgcctgcaggactgccgcgagtgcactggaggcatggttgtggggcgggaactgctggcccaatacaccaaacagtatgaagaaaaaccactctttggcctgctccaaaactgggctgaatctgtgggggacaagctgagaaccagtttcctggcatttaacatggacacagttgatgatctcgcctttctgttgaaagcagtgaaatttcgtgaaagggttcttcagcggggtttggtggccagaatttattataaggtaaagaccaagaaggaggattttttccatgcctggaactcgtgtctgcaccacgtggcttctctgtccctggcacacactcaccgagttaccttagagcagttctccctagcagtgaagagctgtcctgaccaagaggaccagactttgttaatgaagttttgtctgttgtatggaaccaagctggtgtttcaggagcgggcctggtatttagaacataaatacttgactcccatggccagcacgaggatcaggaatcagttgctggatttgtgcgactcggtgaaggatgatgcccggagggtgatctcgacctttaacattccacacacctacctccacgcaccaatcgccggaatctccaacccgcgggccgcgtgggctttctaccctgcaccgctgcagccgcggccacgggaagaggcgcgctcccggcggcccaagctgggagccaagctctaacgggtgtggcgggaagtgtggtggcccgccagcagctgccacgacgctcgctccaccgacgcccagagctgtggccgaggccgggggctggcacccgctgggccgccactctcggggattttggtggcaaagcggaggtcccgccgaggctggcgaggtgcgcggctggctgctaggaaagagatccagacggtcgcctggtgcgctggatccctgtgccctttccctgaaacccagcctggcctgactgcaacctctcccaacttcagtgccggatcccctagacaatcagggtgggctccccgctgcgagcgcgccccacagccgggtgccgccaaaggtctcctgctgttagcggtgactcacattcccagtgatttagaaaaactgtggtgccgagtgaaag

SEQ ID NO: 2928 - DNA, 2718 bp, Homo sapiens
gtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaagtggttgcttagatttaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccagacgctgctgctgggggtgcccagacccttgctgatggcttcacttctccaactccccctgttgtttcttccactccccctacaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggtataacagcataactgtgtagccaaaacaaaatcagattaagactgattcagaaaaatctgggatctttctcaggaatactgtatacccttgggatttctcctcctgcagaatctgtggcattggatgttcttcattgcctgtgctaaggggttaacctcatggcccagtgggtaccctagccccttcttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaactcacttgcatcccttcatgtttctgtttgtggattataaggatgatgaaatgtgaaagtctcccaacactctgagggtggtgaacgattgccacccgtttgattttaatgtgctgctgcatgagactgcattgttgctaatggccagtgtacccagatgtgaagtgtggtaggctggttcatatgtggaggtgggtgtgtgaagctagacacgaaggtccctaaggttctgaagagacttgaactgtggaaatgctcttagcaggcatcccgaacccctgcttcggtgctgttttgaggagtaggatcttggagttcagaccaactatgactatcatttccttcactatctagaaaaacgctattctactttggaagagaatagtagttattttcaagtctcctgacagtcactgggagtacaaggtttgctaatgtgctctctggacgttattaatggccagtattagttgctgctgtattactgactcgcttagctgtagaaagggtaatactctcctgattttgtatgattggactcttaagtagctgctgttagtcagaattaaaacccatctcagactaagaatataatgaataagattaataggccaaaatatgtatctaatcacattgataaaaattaata

SEQ ID NO: 2929 - DNA, 3922 bp, Homo sapiens
gcggtacgggggtggtgccgcgctcctggccccgcgcgggcggacggcggaggcgcctcccagcctgctatgggatggatgaagaagagaaccactatgtctcgcagctcagggaagtctacagcagctgcgacaccacggggactggctttctggaccgccaggagctgacccagctctgccttaagcttcacctggagcagcagctgcccgtcctcctgcagacgcttctcggaaacgaccatttcgccagggttaactttgaggaatttaaggaaggttttgtggctgtgttgtcttcaaatgctggtgttcgcccctcagatgaagacagtagttctttggaatcagctgcctccagtgccatccctccaaagtatgtgaatggttctaagtggtatggccgtcggagccggcctgagctatgtgacgctgccacagaagccagacgcgtgccggagcagcaaacccaggccagcctgaaaagtcacctctggcgctcagcgtctctggagagcgtggagagtcccaagtcagatgaagaggccgagagcactaaagaagctcagaatgaattatttgaagcacaaggacagctgcagacctgggattctgaggactttgggagcccccagaagtcctgcagcccctcctttgacaccccagagagccagatccggggcgtgtgggaagagctgggggtgggcagcagcggacacctgagcgagcaggagctggctgtggtctgccagagcgtcgggctccagggactcgagaaagaggaactcgaagacctgtttaacaaactggatcaagacggagacggcaaagtgagtcttgaggaattccagcttggcctcttcagtcatgagcccgcgctacttctagagtcttccactcgggttaaaccgagcaaggcttggtctcattaccaggtcccagaggagagcggctgccacaccaccacaacctcatccctcgtgtccctgtgctccagcctgcgcctcttctccagcattgacgatggttctggcttcgcttttcctgatcaggtcctggccatgtggacccaggaggggattcagaatggcagggagatcttgcagagcctggacttcagcgtggacgagaaggtgaaccttctggagctgacctgggcccttgacaacgagctcatgacagtggacagtgccgtccagcaggcagccctggcctgctaccaccaggagctgagctaccagcaagggcaggtggagcagctggcaagggagcgtgacaaggcaaggcaggacctggagagggccgagaagaggaacctggagtttgtgaaagagatggacgactgccactccaccctggagcagctcacggagaagaaaatcaagcatctggagcaggggtaccgggaaaggctgagcctcctgcggtctgaggtggaggcggagcgagagctgttctgggagcaggcccacaggcagagggccgcgctggagtgggacgtggggcgcctgcaggctgaggaggctggcctccgcgagaagctgaccctggccctgaaggaaaacagtcgcctacagaaggagattgtggaagtggtggaaaagctttcggattcggagaggctggccctgaagctgcagaaggacctggagtttgtgctgaaggacaagctggagccacagagtgcagagctcctggcccaggaggagcggttcgcagcagtcctgaaggaatacgagctcaagtgccgggacctgcaggaccgcaacgatgagctgcaagctgagctggaaggcctgtgggcgcggctgcccaagaaccggcacagcccctcatggagcccggatgggcgcagacggcagctccctggactcggcccagcaggcatttcattcctgggtaattctgctccagtgagtatagaaacggagctgatgatggagcaggtaaaggagcattaccaagacctcaggacccagctggagaccaaggtaaattactacgaaagggaaattgcggcactgaaaaggaactttgagaaggagaggaaggacatggagcaggctcgcaggcgcgaggtcagcgtgctggagggtcagaaggccgacctggaggagctccacgagaagtctcaggaggtcatctggggcctgcaggagcagctgcaggacacagcccgcggccccgagcctgagcagatgggcctggcaccctgctgcacccaggcactgtgtggcctggccctgcggcatcacagccacctgcagcagatcagactggagttccatagactttctgaagaaaacactttgttgaaaaacgatctgggaagggttcggcaagagcttgaagctgcagaaagtactcacgatgcacagaggaaggaaattgaggttttaaagaaagacaaggaaaaggcctgctctgagatggaggtgctcaacagacagaatcagaactacaaggatcaattatcccagctcaatgtcagggttcttcaactgggacaggaggcttctacccaccaggcccaaaacgaggagcatcgtgtgaccattcagatgttaacacagagcctggaggaggtggttcgcagtgggcagcagcagagtgaccaaatccaaaaacttagagttgaacttgaatgcctgaatcaggaacatcagagcctgcagctgccatggtcagagctgacccagacccttgaggaaagtcaagaccaggtgcagggagctcacctgaggctgaggcaggcccaggcccagcacttgcaggaggtccggctggtgccccaggaccgtgtggccgagctgcatcgcctgctcagccttcagggagagcaggccaggaggcgcctggatgcacagcgggaagaacatgagaaacagctgaaagccacagaagagcgggtggaagaggcggagatgattctgaagaatatggaaatgctcctccaagagaaagtggataagctgaaggagcagtttgaaaagaacacgaagtccgacctgctgctgaaggagctgtacgtggagaacgcccacctggtgagagcacttcaggccaccgaggagaagcagcgaggcgccgagaaacaaagccgcctcttggaagaaaaagttcgcgctctcaacaaactcgtcagtaggattgcccccgcagccctctctgtgtaaagacagattattttctaggattcattcgaaagcacatcttttaaattaagccactgtgctgccttagattccgtgggtcatgagccatgagtcctgggacatctgaggattgggattctttgttcaccccgcagatagttaatgaatggtctgccctgggcaagatggaggtgggggctgggggaatatgcatgttgcagaagccggcgtttttattagcggtcctgagtaatttcccttggcaaaattcccagttttgccactctctggagccagatcctgggagctgtcagcaaggagcaggtaagtgagcagttatggacagcactttccatgtggtgcttccgaccctggctgtcagagtgaaatgtaaagtcagggctctgtacagttttgccatttcactgttctgctttaagcttagcttattagaactcttggtggagggtgcgtacacacattccagaaaaggcttcactcgctgggaacgtcaacccagcgagaaaggaggggaagccccttctccggggaccttatctgtggactcaggaatgatggtgtttattgcaaatgcacaatctttttcccattgaaatgtcatcacactggaaattgtactatatgtaaaaaaaaaaaaaagtatagttttatatttgaaatgtatgcaaattatggccatatggctgattggaatgtactactgtaatataaaaagtcactgtatttgcaataaattcttttctatt

SEQ ID NO: 2930 - DNA, 627 bp, Homo sapiens
tgctgtggctgctccggaggctgtggctccggctgtggaggccgtggctccggctgtgggggctgtggctccggctgtggaggctgtggctctggctgtgggggctgtggctccggctgtggaggctgtgggggctgtggctccggctgtgcgggctgtgggggatgcaaagggggctgtggctcttgcgggggctccaagagaggctgtgtctcctgtggggtgtccaagggggcctgtggctcctgtggggggtccaaggggggctgtggctcctgtggggggtccaaggggggctgtggctcctgtggggggtccaaggggggctgtggctcctgtggggggtccaaggggggctgtggttcttatggctgctcccagtccagctgctgcaagccctgctgctgctcctcaggctgtgggtcatcctgctgccagtccagctgctgtaagccttactgctgccagtccagctgctgtaagccctactgctgccagtccagctgctgtaagccctgtagctgcttctcaggctgtggatcatcctgctgccaatccagctgctacaagccctgctgctgccagtccagctgctgtgtccccgtgtgctgccagtgtaagatctga

SEQ ID NO: 2931 - DNA, 1710 bp, Homo sapiens
agttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccagttctcaacgggaatgctttcaacttttccccattcaacatgatgttggctgtggatttgtcatatatggtttttattacttcgagcccctcatatggaaaatttgaaatgcagaggggaaacagtagcaaaggagatcagtgaagccatgaagtccttgcctgcattaattgaacaaggagagggattttcccaagttctcaggatgcagcctgttatccacctccagaggattcaccaagaagtcttttccagttgtcataggaaaccagatgctaaacctgagaactttataacacagatagaaaccacaccaacagagactgcttccaggaaaacctctgacatggtactgaaaagaaagcaaactaaagactgcccccagagaaaatggtatccattgcggccaaagaaaattaatcttgatacatgagctctttctgtttattttgggagttgaaaataggcaccatcaacatttagattacagcctaattaatacctagataagacttcatttgaaataagaaataactcttttactagtgattcatttatacagatatagtatctctgtgcggggatatgatataatattgtatttccttactgttttatctattgtaaataaaaagcattttaaaaagtattgacacaaagcccatcagtgggcattaaaaatattaaaagtgcagacttttactgtccttaagtgccatcaactctcagctcccttgtagcttttgtgggatttaacaagtaacaaattctgttgtgtttccctggtatacatctttctaggaaaaaaaaaaaaaagagagagagctgtataatgatttttcgtttacatgctgaaaagtaattatcagttctgcacagcagcagatgcagggtttttttttaaagatgtagtttgatttatcaaattaatgtgctgatgataatactggctttgactttgttactccatgttcagctaatttaggtttgtgagattaactttaggattttttgttgtgtaagacaatgataactattatttgtgcaacattactctttgaaataaaaattggcatgtagccaatgtttcctgcccacactcacttttttctatagaccattaacataatttgacttggaactaatggtttctttttagggtttcttatttatttctttacaaatcattccagttcaa

SEQ ID NO: 2932 - DNA, 3990 bp, Homo sapiens
agcctcgtgtaacaatacttgtgccctggctgcagtctgcggggccgcgccctgggcctgccgcattcggccaacgcacagcatctgaggagggttatgaccatctggcagatgcagaaacaggcccagagagggagccccgcgcggactcactctatgatgtccctgtcggtgcggccgcagcgccgtctgctcagcgcccgggtcaataggagccagtccttcgcaggcgtcctcggcagccacgagcgggggcccaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacggcctacttggaagtgcaccagcaggagcaagagaaactccaggggcagataagggagtccaagaggaattcccgcttgggcttcctgtatgatctggacaagcaagtcaagtccattgaacgcttcctgcgacgactggagttccatgccagcaagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaagtcccacccacaaaaccagtatgtcacctcccaccactacaagtcctacccccagtggtatgggcctagtccagactgccacaagtcccacccatcctaccacaagccccacccatcccaccacaagccccatccttataaatgtaagcccttccacttctctagaacttgctaccctctccagcccctccaaacactcagaccccaccctcccaggcactgactcccttccctgtagtcccccagtctccaattcctacactcaggcagaccctatggcccccagaactccccacccaagtcctgcccattccagtaggaaacccctcacaagccctgccccagatccctcagagtctacggttcagagtctaagccccactccctcacccccaacccctgcaccccagcattcagacctttgcctggccatggctgtccagaccccagtcccaacggcagccggagggtctggggacaggagcctggaggaggcactgggggccctaatggctgccctggatgactaccgtggccagtttcctgagctgcagggcctggagcaggaggtgacccgcctagaaagtctgctcatgcagagacaaggtctgactcgcagccgggcctccagtctcagcatcactgtggagcatgccttggagagcttcagcttcctcaatgaagacgaagatgaagacaatgatgttcctggggacaggcctccaagcagcccggaggctggggctgaggacagcatagactcacccagtgcccgccccctcagcacggggtgtccagctctggatgctgccttggtccggcacctgtaccactgcagtcgcctcctgctgaaactgggcacatttgggcccctgcgctgccaggaggcatgggccctggagcggctgctgcgggaagcccgagtactggaggcagtatgcgagttcagcaggcggtgggagatcccggccagctctgcccaggaagtggtgcagttctcggcctctcggcctggcttcctgaccttctgggaccagtgcacagagagactcagctgcttcctctgcccggtggagcgggtgcttctcaccttctgcaaccagtatggtgcccgcctctccctgcgccagccaggcttggctgaggctgtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccctgagattggcgcccgaggggcgtctgcgaagggacgggctgcgggccctcagctccctgctcgtccatggcaacaacaaggtcatggctgctgtcagcacccagctccggagcctgtcactgggccctaccttccgggagagggccctcctgtgcttcctggaccagctggaggatgaggacgtgcagactcgagtggctggctgcctggccctaggctgcatcaaggctcccgagggcattgagcccctggtgtacctctgccaaactgacacagaagctgtgagggaagctgcccggcaaagcctacagcagtgtggagaagagggacagtctgcccatcgacggctggaggagtccctggacgccctgccccgcatctttgggcctggcagcatggccagcacagcattctaaactattcacccatgggttcctggtgcccctttccccccactttcagggctcaccaggcactggcagggagggtaagggctggctccagatacccctcccccacagattcctagcaatgaaaatctaatatattcttctgttgcccctggggttggagagtcagtgcctgcagtc

SEQ ID NO: 2933 - DNA, 1137 bp, Homo sapiens
agttcagcgcagcgactcggggacctggagctgacgcctagttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggtagggtgaagcctctgccctttccacgtttctctccttgtggatggacccttttctggaagaaggaggcagcccagtgccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggtcctattaccctctccagctgccactgccagagctggattcctgtaaaggagtccaggctagagccacagagactgttgt

SEQ ID NO: 2934 - DNA, 573 bp, Homo sapiens
gttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctggtcttgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggatttccaatttccaagcctgatgggatctcccagctggaacaggatctacaggtctttgatctggaaactaagactagagaagtcttaagagatgactgctcagatggagagaccagagaagagaacaagctgttgattcctaagcagaaaatttcggaagaagtgcattcatacaaagtgagagtaggaag

SEQ ID NO: 2935 - DNA, 4469 bp, Homo sapiens
atgagcctggagcgcgagcttcgccagctgagcaaggcgaaagccaaggcgcagagggccgggcagcggcgcgaagaggccgcgctgtgccaccagctgggggagctcctggccggccatggccgctacgccgaggctctggagcagcactggcaggagctgcagcttcgggagcgcgctgacgaccctctgggctgtgccgtggcccaccgcaagatcggagagcgcctggccgagatggaggactacccggctgccttgcagcaccagcaccagtacctggagctggcacattccctgcgcaaccacacggagctgcagagggcctgggccaccatcggccgcacccacctggacatctatgaccactgccagtcgagggatgctttgctgcaggcacaggctgcctttgagaagagcttggctattgtggatgaggagctggaggggacactggcccagggagagctgaatgagatgaggacccgcctctatctcaacctgggcctcacctttgagagcctgcagcagacagccctgtgcaacgattacttcaggaagagcatcttccttgcggagcagaaccacctttacgaggacctattccgcgcccgctacaacctgggcaccatccactggcgcgcgggccagcactcccaggctatgcgctgcttggagggtgcccgggagtgtgcgcacaccatgaggaagcggttcatggagagcgagtgctgcgtggttattgcacaggtcctccaagacctgggagactttttggctgccaagcgagccctgaagaaggcctacaggctgggctcccagaagcctgtgcagagggcagccatctgtcagaacctccagcatgtgctggcagtggtccggctgcagcaacagctggaagaggctgagggcagagaccctcagggtgccatggtcatctgtgagcagctaggggacctcttctccaaggcaggagactttcccagggcagctgaggcttaccagaagcagctgcgttttgctgagctgctggacagaccgggtgctgagcgggccatcatccacgtgtccctggccaccacactgggagacatgaaggaccaccatggggccgtgcgccactatgaggaggaactgaggctgcgcagcggcaacgtgctggaggaggccaagacctggctgaacattgcactgtcccgcgaggaggccggcgatgcctacgagctgctggccccgtgcttccagaaagcgctcagctgtgcccagcaggcccagcgtccccagctgcagaggcaggtcttgcagcatctccataccgtgcagctgaggctgcagccccaggaggcccctgagaccgaaaccagactacgggagctcagtgtagctgaagatgaagatgaggaggaggaggcggaggaggcggcagccacagcggagagcgaagccctggaggccggcgaggtggagctctcagagggcgaggacgacaccgatggcctgaccccgcagctggaggaggacgaggagcttcagggccacctgggccggcggaaggggagcaagtggaaccggcgaaacgacatgggggagaccctgctgcaccgagcctgcatcgagggccagctgcgccgcgtccaggaccttgtgaggcagggccacccccttaaccctcgggactactgtggctggacacctctgcacgaggcctgcaactacgggcatctagaaattgtccgcttcctgctggaccacggggccgcagtggacgacccaggtggccagggctgcgaaggcatcacccccctccacgatgccctcaactgtggccacttcgaggtggctgagctgctgcttgaacggggggcgtccgtcaccctccgcactcgaaaggcctcagcccgctggagacgctgcagcagtgggaagctgtaccgcagggacctggacctggagacgcggcagaaggccagggccatggagatgctgctccaggcggctgcctcgggccaagatccccacagctcccaggccttccacaccccaagcagccttctgtttgaccccgagacctctcctcctttgagcccctgcccagaacccccctctaatagcactagactcccagaggcctctcaggcccatgtcagggtctccccagggcaggcggcaccagccatggccaggcctcggaggagcaggcatgggccagccagcagcagcagcagctcagaaggcgaggacagcgcaggccccgcacggccgtcccagaagaggcctcggtgctcggccacagcacaacgggtggcagcctggacgcctggccccgccagcaacagggaagcagccacagccagcaccagccgggcagcctaccaggcagccatccggggtgtgggcagtgctcagagccggctggggcctggcccaccgcggggccacagcaaagcccttgccccccaggcagcgctcatcccggaggaggagtgcctggccggggactggctggagctggacatgcccctgacccgcagccgccggccccgcccccggggcactggagacaaccgcaggcccagtagtacctctgggtcggacagtgaggagagcaggccccgtgcccgagccaagcaggtccgcctgacctgcatgcagagttgcagtgcgccagttaacgcagggcccagcagcctggcttcagaacctccagggagccccagcacccccagggtctcagagcccagtggggacagctctgcggcaggccagcccttgggtccggccccgccccctcccatccgggttcgagttcaagttcaggatcatctcttcctcatccctgtcccacacagcagtgacacccactctgtggcctggctggccgagcaggcggcccagcgctactaccagacctgcgggctgctgcccaggctcaccctacggaaagagggggccctgctggccccacaggacctcatccctgatgtgctgcagagcaatgacgaggtgttggctgaggtgacttcgtgggacctgcccccgttgactgaccgctaccgcagggcctgccagagcctggggcaaggggagcaccaacaggtgctgcaggccgtggagctccagggcttgggcctctcgttcagcgcctgctccctggccctggaccaggcccagcttacacccctgctgcgggccctcaagctgcacacagcactccgggagctgcgcctggcagggaaccggctgggggacaagtgtgtggctgagctggtggctgccctgggcaccatgcccagcctggccctccttgacctctcctccaatcacctgggtcccgaaggcctgcgccagcttgccatggggctcccaggccaagccaccttgcagagtttggaggagctggacttaagcatgaaccccctgggggacggctgtggccagtccctggcctccctcctgcacgcctgccccttactcagcaccctgcgcctgcaggcgtgtggcttcggccccagcttctttctgagccaccagacagcactgggtagtgctttccaagatgctgagcacctgaagaccctgtccctgtcctacaacgccctgggagcccctgccctggccaggaccctgcagagcctgcccgccggcaccctcctgcacttagagctcagctccgtggcagccggcaagggtgattcggacctcatggagcctgtattccgatacctggccaaggaaggctgtgctctagcccacctgaccctgtctgcaaaccacctgggggacaaggctgttagagacctgtgcagatgtctctctctgtgcccctcactcatctcactggatctgtctgccaaccctgagatcagctgtgccagcttggaagagctcctgtccaccctccaaaagcggccccaaggccttagcttccttggcctgtcaggctgcgccgtccagggtcccctgggcctgggcctgtgggacaagatagccgcgcagctccgggaactgcagctgtgcagcagacgcctctgcgctgaggacagggacgccctgcgccagctgcagcccagtcggccgggccccggcgagtgcacgctggaccacggctccaagctcttctttcggcgcctctgaccctggcgctgcctttccccaccctcaccgaagcccctaataaatgaagctgctggccgggcgcggtggctcacgcctgtaatcccaacactttgggaggcccaggcgggcggatcacgaggtcaggagatcgagaccatcctggctaacatggtgaaaccccgtctctactaaaaataccaaaaattagccgggcgtggtggtggaagcctgtagtcccagctactccggaggctgaggcaggagaatggcgtgaacccgggaggcggagcttgcagtgagccgagatcgcaccactgcactccagcctgggcgacagaccgagactccgtctc

SEQ ID NO: 2936 - DNA, 679 bp, Homo sapiens
ggggaaatgccgaccctattcaaaggagtttggggggttgtggagcattccagagctctgggaagattctgtcccgcctgcttaccctcaggcccacacctccacacacagccagctctgggcactgcagaaatgacgctcctctcctcccagtcttcatcactggtggccccttctgggtctgtgtctgccgaaaatccagagcagaggatgctggagaagagagccaaggtcatagaagaacttcttcagacagaaagagactacattcgggatctggaaatgtgtattgagcggatcatggtacccatgcagcaggcacaggtaccaaacattgattttgagggactttttggaaatatgcagatggtgattaaggtctcgaagcaattattggctgctctggaaatcagcgatgctgtaggacctgtgtttcttggtcaccgggatgagcttgagggaacatacaagatttactgccagaatcatgatgaggccattgcgctgcttgaaatctacgagaaggatgagaagatccagaagcatcttcaggactccttggcagatctgaagagcctatacaacgaatggggatgcacaaattatattaacctgggctccttcctcatcaaaccagtacagagagtaatgcgttacccgctgttgctaatggagttgc

SEQ ID NO: 2937 - DNA, 564 bp, Homo sapiens
gtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggttagttttaaagtaaatgggattcaaccatttttaaaaattattttgctataacatgaaggattccctttcacttttattttataaccatgaccctaaagaatttaaattttgctataggtacccctaagctgagaaacagggggggtgtccaggtgagctgaatgaactgttcagtttggtcttctgcttttctttttttatttctttgcttattatgtgctgttaactttctttaaagtagcatgtaatttgctttagaaa

SEQ ID NO: 2938 - DNA, 579 bp, Homo sapiens
ttattgtgacgccgaaaacggagaaaccccgggtccggcgagaggggctgtgacagtcggagtcccaagctgcggttcggctgctgccgagaactgcaaggtgtggaatatttctggcttctagtccaatgccaagtgtgtgacctgtgttttggccctacatttatttaaagcctgaatttggggagtatctgcaaagcactgaaggttttggacattgtcttttcctgctgttgaaagagaccctcttcatatatacaacattcaggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaattggagctctggcagatcagcatatcattcatgtggcatgtggcgagtcc

SEQ ID NO: 2939 - DNA, 1124 bp, Homo sapiens; identical to SEQ ID NO: 2733

SEQ ID NO: 2940 - DNA, 4090 bp, Homo sapiens
gcatgatgggagagtgtgtggagtgggcggggggtctccgcggaggaggtggaggaggcggcggcggcggcggaagagggcggagggtagtgggatgggggtcccgcggcagcggtgaaactccgggtgggcgtccatggtgctgctgcgctgacagggctgtgagcagccggccttccgctctcaccagttccgcgtcggaatagacggtccttccccggggagtcagttcctccccgggcccctgagccatgcccatcgcagccgccccgaaggagccaggtgtaaattaattatttgaaagcaactgaacaatggagccagacatcattcgaatgtactcttcatccccaccaccattagacaatggagcagaggatgatgatgatgatgaatttggggaatttggtgggttttcagaagttagcccttctggtgtagggtttgttgatttcgatacaccagattatactcgtcccaaggaagagtttgtaccttcaaaccattttatgccaattcatgaattctcagaaaatgtagatagccttacaagctttaagtccattaaaaatggtaatgataaggacatcactgctgaactttctgctcctgtgaaaggacagtctgatgttttactttctaccaccagcaaagaaataatttcatctgaaatgttagctacttccattgatggcatggaaagaccaggaaatttaaataaagtagtggagcagagacagaatgttggaacacttgaaagtttctctccaggagattttagaactaatatgaatgttgttcatcaaaacaagcagttagagagctgcaatggtgaaaagcctccttgtctggagattctaacaaatgggtttgcagtgttggaaactgtaaatcctcagggaacagatgatctggacaatgtagctgattcaaagggacggaagcctcttagcactcatagcactgagtataatttagactctgtacctagtcctgctgaggaatttgcagattttgccacattttccaaaaaggaaaggatacaattagaagaaatagaatgtgcagttttaaatgatagagaagcactaaccattcgggaaaacaataaaattaatagagtcaatgaactgaattctgtaaaagaagtggctttgggtagaagcttggataacaaaggagacactgatggagaggatcaggtttgtgtttcagaaataagcatagtgactaacagaggtttcagtgttgaaaaacaaggccttccaacactgcaacaggatgaatttttacagtcaggtgttcagtcaaaggcttggagtttggtagactcagctgataattcagaagccattaggagagaacaatgtaaaactgaagaaaaacttgacttacttacttctaaatgtgctcacctatgcatggattctgttaaaacttctgatgatgaagttggttctcccaaagaagaaagtagaaagtttactaatttccaaagcccaaacattgaccccacagaagaaaatgatttggatgattctttaagtgtaaaaaatggtgatagtagtaatgactttgtgacttgcaatgatatcaatgaagatgattttggtgattttggtgactttggctctgccagtggctcaactccaccttttgttactggtactcaagattcaatgagtgatgccacttttgaagagtcttcagagcactttccacattttagtgaaccaggtgatgactttggagaatttggggatataaatgctgtttcttgccaagaggagacaatattaacaaagtcagacctaaaacagacttctgataatttatcagaagaatgtcaattggcaagaaaatctagtggaacaggcactgaacctgttgcaaaacttaaaaatgggcaagaaggtgagattggacattttgattctgtgccaaatattcaggatgactgcaatggttttcaagactctgatgattttgcagacttcagttcagctggtcctagccaagttgtagattggaatgcttttgaggatgaacaaaaagatagttgttcttgggctgcttttggagaccagcaggctactgaatctcatcatcgaaaggaagcctggcagtcacataggacagatgaaaatattgatactccaggaacccccaaaacgcacagtgtaccttcagcaacttccaaaggagcagttgctagtggccatttacaggaatcagccacttcagttcagacagctttattaaaccgcctggagcgaattttcgaagcatgttttccttccatacttgtccctgatgctgaagaggaagttacttccctgaagcacttgctggaaacaagcactttgccaataaaaacgagagaggccttacctgaaagtggggaattgctagatgtgtggactgagctacaggatatccatgatgcacatggcttgagataccagtggggcggctcccatagcaacaagaagcttttgtcctccttgggaatagacacccgaaacattctcttcacgggcaataagaagcagcctgttatagtgcccatgtatgcagcaggattgggtatgttagagcccaccaaggaaccactgaaaccactttctgctgcagaaaaaatagcttccatcggtcagacagccaccatgtcaccagatatgaacacatgtacatctgatcagttccaggagtctctaccacccgtccagtttgactggagtagcagtggccttactaaccctttagatgctagtggaggttccactcttctgaaccttgatttctttgggcccgtggatgacagtagctctagcagcagcaccacaatcccaggtgtggatccggagttgtatgagttaacaacttctaagctggaaatctccacctcaagcctcaaagtgactgatgcatttgcaagactcatgtctacagtagagaagacaagcacatctaccagtaggaaaccgaaaagagaagagcacctaagtgaagaagctatcaaggtgatcgctggccttcctgacttaacattcatgcatgccaaggtgttgatgttcccagccacgttaacaccttccacaagctctcaagaaaaagcagacggataactgatgtgaattggacagtttctattgcttttccttttttccatcccttccctaccatcaaaagcatacctgctctaattaaaaaaaaaaaaaaaaaaaattcaagttcagctgatttgttggtaagccgcactagaaaggtatacatagtaatgtatatttatttacatactgaagtcctaaatttatattagaaaaatgtaaataatcgggggtaaacatttttgaagatttattctttttgtgttgctggggtgtatacatttatgtctttgtgaaatacactggtggtgtccttcttacaaaacttttgaaataaaaaaaaaactcaaatcttcactgtctgtgaaatccccttcagtcttttcagattgcattgactgtcctcttgatttttcatattacatgtcaaattacttttgctatcataaataagctccaaagtcccccatttaatttttttttaattttgtgtatgatgggtttcagatctggcttttgttaacattttggggcttttttaatcttttcaatctggcgtattgctgtttgaccttttgcaaggtacttaattgctcttttgttatagggtatggatcattgtcagaacttgattggaggggtttaaagagattgtgtctgtttaaaatcagtatgattcagagaaggaccaaattatatgaatgtcttacaatggaatttacttgttactgatttttttgttctattgtaccactattttttgaggattttgcacagtgtaaaatgacataatcatagattgctatggtttaggctgtatatacagtgaaaactatgggttttaaatgtttggggaaattcctatggaaaaaagagagacatgtagaagaacctctaacaaggttaatgtgcatgcccaaggtcttttgaaatttcagtgtgtaaatttccttttagcttatacaaaaataaaataattt

SEQ ID NO: 2941 - DNA, 946 bp, Homo sapiens
cgccttctgcctgccccctcggccttcttcacttagccttcgacggccgagcgccccaggggtggcggtgggagtggggttgttgagcggcgctggctcctttcacaaatggggaaactgaggcttaaagggcgtctgactcgccagagcagctcagcctgcagctgctagcagtggcgtctcatattagcattgttgtcaaccggaggcggtgcgagtccgccggggattccagatggggctcctgcgccgcccgcctatcatttgcggcctgtattcgcgcgtcgctcccgcagagccacctcccagcaggcccacgcccgcgggggccccgggctggcgccgctgtccctggaatcgatgtgagtcactgctgacgctttgcaggagcatgcatctcacctcagaaagtctctgacgttgctgcggagcggggagaggatgtttctctattagccctttgcttttgctctggcgctgatcctttgctgaccttggacaaatcaatttacgtttctgtgctccagtttcttggtttataaaagacggtctccttctgtcacccaggctggagtgtagtggaacgatcaccgctgaactgcagcgtcggcttcctgggctcaagcgatcctcccacctcaacctcccaagtcatggggactacagatgccatcacacctggctaatttttaaatttttctgtggagacagggtctcattctgttgcccaggcttgtctcgaaccctggtctaaagtgatcttcccgcctagcctcccaaaatgttggaattacagtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatg

SEQ ID NO: 2942 - DNA, 582 bp, Homo sapiens
agcagcgcgcaggcgcacgtcagtccccgcgcttttcggaggctgccagcgtcccacaccagccgcaggatagcagcatcaaggagcattgtgtacatgcagaagtgcacagtacctggagtgaaactgcttgtgttcgatttctgataccattcataactggctgtgtgatctcaaataagaaaactgaagaaccagctgggcgcggtagctcacgcctgtaatcccagcactttgggaggctgaggcgggtggattacctgagaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtgacaagtggcagtctg

SEQ ID NO: 2943 - DNA, 603 bp, Homo sapiens
gtgcaggagcgggacccggaacagaccgccgtgagagaggaggggcgccggccgggattcgcggcccggagctcgggaccggagaagaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaagga

SEQ ID NO: 2944 - DNA, 593 bp, Homo sapiens
ccggatccggtctcagctctgggagggaacgggagatgttgcaggcgccgagagggcgggccagggccgcactccggagactcgcggttgctacgcgcaccatggctggagcgcccacggtctcgcttcctgaactccgttcactcctagcctccggacgggcccggctcttcgacgtgcgctctcgcgaggaggcggcagctgggaccatcccaggggcgctcaacatcccggtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaa

SEQ ID NO: 2945 - DNA, 8683 bp, Homo sapiens
gcagaagtctgggcagctgcgggaggagaggtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccaggtccctgagtactgacggtcacaggctgccgcgtctttcctgttgactcatgtttggttcctccagtgaaaattttacttagagaaatgctgcctccaaagcacttgtctgccaccaaacctaagaagtcctgggccccaaatctgtatgagctagacagtgacttgactaaggagccggatgtcatcataggagaaggtccaactgactctgagttttttcatcagaggtttcggaacctaatctatgtggaatttgttgggcctcggaagaccctgatcaaactccgaaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcgtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaattttttttttttttggaggaggaagagagcaacaaatttgattatatttttaagtgtcttagatcctgagaaagatttattgtgcattatttgaaccctgtcaatatctttttgagtaattgttttgtttcttacccttaaatagtcttgtgaagctgtaggcatgatagataacatggcttttactccttactgtttgaaaagataagtactttagcttctttctgcagccatttcatctgcgccaacactttggaacctaatactgtgtaaggctttacaatatacggattggctttttgtgacccagattgattggttgccacatgttatgtttgttgaagtggttctcatgcaaaaatattacacatttgtgttctgggttttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaaaaaaaaaattctttacagtcaacccaagcttaacatggactcaggttccccagcagccttaatttgttttgttaacatctgttccttctttttcagctctcctagagtatttctgagtgttgtgttcatctaatcttagtattcttttaattacaaattgacctcacagcttgaggtttcttgtgtcctattctgtggactacctgtgctcctttgcttcccctcccctcgcataataactatattaagaaattttttttggccttgagttggctggaaaaaaaatataaaatttaaaaaatttaaaaaaaaagatttgcaaaatgtaagtgtagatcatttgaacaagcaaaattaaagtacccactgggggaaatgtgtctgaatcttactcttctggatctgcaggattagggcttggaagtatgtcaaagatgcagggagtgtcaaagtttaggaagattgtagagctgagagcaagaagcagaaatgagtgagtcaaagaagggagtcctaatatatcaccagatctaggaggggagaggagacagacagaagaaaacaccagaggcaagaactgtagaaggccaggtttctgagaatgaattgagcggggtgtcctgagcagtttggaaaaggagtttttgatggtatggtgtaggtgagggctggctgcataggaaggactgaggttggaacggacatcgggaaagctgaggggcagtgaggtttactacatgggaaaaggactcttgaaacgagaatcagtgttgatgtcggggtgaactttgtgggtacattacttggtgttaacattgttggcagtggtagccccttttcagaaagcaacttgctgtaagtcagggtgtccgttccaaccttcagctagtgaaaaggtagtaacaaatggtaaacaagagaatgattgtttaaacctatctgtggacacttaatgcaactgtttaaaaatgataatcacgagttatgtagcaacgtggaaatatatttacagaacattaagtggagaaagcaggacacgaaagtatatttatactacagttataactcaacagttcatttatatgctgttcatttaacagttcatttaaacagttcattataactgtttaaaaatatatatgcttatagtcaaaagctgttgtggtgttgttgttgtaggcttatagttgagcattattttcttaaatttcttgaatgttctttatggtagtgttactaaaaagtttatgatcacattttcattgtgaacataatttgaactcattatcacacacttggaaaatacagaaaagtggaggaaaaaaaatcatatccccaccatccaaagacatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggtgtgcataatacatacccagaggaaaaattagaaaataaagtaaattattttaaaaaattacctatattcccaacacctaacaactactgctaacatcttgatctgtttcctctatcttgtttcagtgcacacgcttgtgataacagtgttaaatatgtgtgcataaagtcttaaatgaaaagatgtggaaaataactaaaatagtgttgtcattgtgggaatttggttaaatattttgtctcaaattccttaaataatctttggtgttttggtaataaattttatgtatgtattttccattacaaatataatacatactcatacaaaactttggaaattcagtaaagaaaattcacacatattcccaacacccaacaacaattaactgttaacatcttgatctgtgcactagtctgtgattattagggtgttagtgataagtatgcataaatgtcaaagatgggaagaaagatgaaaaacaagaaatagttgtgtggttgttgtgggattatggttattttgtttcggtttccttgaaaggtcatcattctagtgttttggtagtccacctttactacatatatttccattatatatgaaatgtgttcattatagaaactttgaagttacagaaatgtagaagagaaactcacccatgttttcaccatccaaagagtgtggttaacatcttgatatattttcttcatcttgtttctgtgcacaggtttttggtttgttaatatggttgtggtcattctatctgtaatagtgtcaacaataaaaataaagttaaaaataaatattt

SEQ ID NO: 2946 - DNA, 589 bp, Homo sapiens
agtctggtcctcactgctgtggattgcctttactaaaatagagatctatgcagaaatacagttgcatagcttttcacataaggctcttcatgatatggcctttgcctgcttttatggcatggtccatctactctgccccatgtgcctctccttgctgccatacagaactctatcaggggaacctgcccccaatatttcaaggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgta

SEQ ID NO: 2947 - DNA, 1720 bp, Homo sapiens
agcacactggaaggagtcatggcggatggtcaggtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagggcagccatgaggcccgtgtgtttcgaagcattcccccagagggcctggcccagagcgagcttatgcgactgcccagtggcaaagtgggcttcagcaaggccatgtccaacaagtggattcgggtggacaagagtgcggctgacgggccccgggtgttccgagtggtggacagcatggaggatgaggtgcagcggcggctccagctggtccgggggggacaggctgagaagctgggggagaaggagaggagcgagctgaggaagaggaagctgttggctgaagttggctcttggcgggaccggcccttcaagccctacaacttcttggcccacggtgtcctccccgacagcggccaccttcacccgctgctcaaggtccgctcccagttccgacagatcttcctggagatggggttcaccgagatgccgactgataacttcattgagagctccttctggaactttgacgccctcttccagccccagcagcacccagcccgtgaccagcacgacaccttcttccttcgagatccagcggaggccctgcagctcccaatggactatgtccagcgggtcaagcggacccactctcagggcggctacggctcacaggggtacaagtataactggaagctggacgaggcccggaaaaacctactgcgaacccacaccacatcagccagcgcccgtgcgctctaccgccttgcccagaagaagcccttcactccggtcaagtacttctccatcgaccgcgtattccggaatgagaccctggacgccacgcacctggctgagttccaccagatcgagggcgtggtggcggatcatggtctcaccttgggccacctcatgggcgttctgcgggagttcttcaccaagctgggtatcacgcaactccgcttcaagccagcctacaacccatacacagagcccagcatggaggtgttcagctaccaccaaggcctgaagaagtgggtggaggtcggaaactcgggggtcttccgtccagagatgctgctgcccatggggcttcccgagaacgtgtcggtcattgcctggggcctctccctggagcgcccaacgatgatcaaatatggcatcaacaatatccgggagctggtgggccacaaggtgaacctgcagatggtgtatgacagtcccctgtgccgcctggatgccgagccgaggccccctcccacacaggaggctgcgtgacatgggccactctaggacaggtcatcctccccgagtccctgctgctgcgctcctttgcatccctggccagtgaccttgtatttatgaggcctctgtgaggccagcccccaccttcctctttcccacctgtcccaggaccagaatcccagggacagaggactgggtagcaggttccttctgttgtcctgtgtggtgtgtctactgtgagggtgggccctgaggagacctgtgggccacctattgtctaataaagtgggcagttgccccc

SEQ ID NO: 2948 - DNA, 3564 bp, Homo sapiens
gtcgcggccttcgccgccgccaacggggctgtccctgtagctcccgatggagtttgaggtcgtgaaacctccgccgagctctgccccggcgagacgaggcgcctccgtcgccaagccgcgccgtcgcggggctcccgggagcggcccttagcgaccccgcccgggccccctcagcttacaaaacactacacagcaaaataatgatctgctagactgctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataagctacagtctccagagtcatttgcaaagagtgtccaggaattgacaattgttttgcaacgaacaggtgacccagctaacttaaatagactgaggcctcatttagagcttcttgcaaacatagaccctaatccagacgctgtttcaccaacttgggagcagctggaaaatgcaatggtagctgttaaaacagtagttcatggccttgtggacttcatacaaaattatagtagaaaaggccatgagacccctcagcctcagccaaacagcaaatacaagactagcatgtgccgagatttgcgacagcaagggggttgtccacgaggaacaaattgtacatttgcccattctcaggaagagcttgaaaagtatcgattaaggaacaaaaagatcaatgccactgtaagaacgtttcctcttctaaataaagttggtgtaaacaacactgtcacaaccacagccggaaatgtcatttctgtcataggaagtactgaaacaacagggaaaattgttccaagtacaaacggaatttcaaatgcagaaaacagtgtttcccagctaatctcacgtagtactgacagtaccttaagagctctggagaccgtgaagaaagtgggaaaggttggcgctaatggtcagaatgctgctgggccctctgcagattctgtaactgaaaataaaattggttctccacccaagactcctgtaagtaatgtagcagctacctcagctgggccctctaatgttggaacagagctgaattctgtgcctcaaaaatccagcccatttctaactagagtaccagtatatcctccgcattctgaaaacattcagtattttcaagatccaaggactcagataccctttgaagtcccacagtacccacagacaggatactatccaccacctccaacggtaccagctggtgtggctccctgtgttcctcgctttgtgaggtccaataacgttccagagtcctccctcccacctgcttccatgccatatgccgatcattacagtacattttcccctcgagatcgaatgaattcttctccttaccagcctcctcctccgcagccgtatggaccagttcctccagtaccttctggaatgtatgctcctgtgtacgacagcaggcgcatctggcgcccacctatgtaccaacgagatgacattattagaagcaattctttacctccaatggatgtgatgcactcatctgtctatcagacatctttgcgggaaagatataactcattagatggatattattcggtggcttgtcagccaccaagtgagccaaggacaactgtgcctttaccaagggaaccttgtggtcatttgaagaccagttgcgaggagcagataagaagaaagccagatcagtgggcacagtaccacactcagaaagcacctcttgtctcttcaactcttcctgtggcaacacagtcaccaacaccaccttctcctctgttcagtgtagactttcgtgcggatttctcagagagtgtgagtggtacaaaatttgaagaagatcatctttcccattattctccctggtcttgtggcaccataggctcctgtataaatgccattgattcagagcccaaagatgtcattgctaattcaaatgctgtgttaatggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcagattatgtcccttatgtcaatgctgttgattcaaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagaggtaaagaaactgaacctttcggcttcatgcttaatgtatttgttttctgctgctgcatcttggttataccattactgagtgcattttggtgtgcctatctctgatggatgattgattgcttttaaaacttataacagaaataaaattgtaatcccagatttcttaaataattctttaactagatcatcgggatttttgtttttttg

SEQ ID NO: 2949 - DNA, 2031 bp, Homo sapiens
ggcggggggttcgcccagcgtcgtggactatttccctagcgaggacttctaccgctgcggctactgcaagaacgagtcgggcagccgctccaatggcatgtgggcacattccatgacagtacaggattatcaggatctcatagaccgaggatggcgaagaagtggaaaatatgtgtacaaacctgtcatgaatcaaacatgttgtcctcagtacacaataaggtgccgacctttacaatttcagccttcaaaatctcacaagaaggttttgaaaaaaatgttgaaatttctagctaaaggggaggttcccaaaggaagttgtgaggatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggcaaaggggctgatttgagtaagcctccatgtcgaaaagcaaaggaaatccggaaagaaaggaaaaggttaaaactaatgcagcagaacccagctggagaacttgagggtttccaggctcaaggtcacccaccatctttgtttccaccaaaggctaaatccaaccagccaaaatcactcgaagatttaatttttgagtctttaccagagaatgcatcacacaagttagaggtgagggtggtgagatcatctccaccaagttcgcagttcaaagccacacttctggagtcttaccaggtctataaacgttaccagatggttattcacaagaacccacctgatacgccaaccgaaagccagttcacaagattcctttgcagttcacccttggaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacgagaaattgcttttactaggcagcttcatgagaaaacttctcaactcagctattattatatgggtttctacattcattcatgtcccaagatgaaatataagggtcagtatagaccttctgatttgctgtgccctgagacatatgtttgggtacccattgagcaatgcctgccttcacttgaaaactccaagtactgccgtttcaaccaggacccagaagcagtggatgaggatcgcagtacggaacctgaccgattgcaggtgtttcacaagagagccatcatgccttacggtgtttataagaaacagcagaaagacccaagtgaggaggctgctgttctgcagtacgccagcctggtggggcagaagtgctccgagcggatgctgctgttcagaaactgacctgttcacctctgccgggaagttcctgtgttgtgctgatgatttgtgccaggatacatattcagtacctgtggggaaataactgtcaccacccacaaattagacattttttattttgactatctatggcttttaaaaaatattttgtggcaatgtatctgtgagaatctcatagttaatataaagattttaaaactgcattatgacctagcccccataattgggatttatcattttggaggattctttctagagcaagatacgctcaaattctcctgtttgtattttgtaaaatgaagaagtgaatctaagtaacttaatcacagttgtgcattttttttggttctgttagagaaattaaaacagactgtttcctcaggcccattttaaactgaacttatgctaggaaaccttaagtatggggaaggtagaaagttcatttcatcacttagaaaatatgtcttctcaagaacaaaactgtgctg

SEQ ID NO: 2950 - DNA, 572 bp, Homo sapiens
tgaaccaccagccagctgcatttgttgtcctggaagtcattgccaactctgccagtcacactggggtccccagagaagtcaagagcctctgggatattgggcacctgaagagctgcagccccagctctgccctcagggagtttctgttttggtggggagaaggccactgaaaccagggagtgcggttgtgtttgcaaacttccaattgaagacactgagctgaaccattccgcccgcccgcccgcccgagggcactccagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggcccctt

SEQ ID NO: 2951 - DNA, 654 bp, Homo sapiens
caaatttgcgcgggttggagcctggcgtagtcatggccgccttccgcgacatagaggaggtgagccaggggctgctcagcctgctgggcgccaaccgcgcggaggcgcagcagcgacggctgctggggcgccacgagcaggtggtggagcggctgctggaaacgcaagacggtgccgagaagcagctgcgagagatcctcaccatggagaaggaagtggcccagagccttctcaatgcgaaggagcaggtgcaccagggaggcgtggagctgcagcagctggaagctgggcttcaggaggctggggaggaggacacccgtctgaaggccagcctccttcagctcaccagagagctggaagagctcaaggagattgaggcggatctggagcgacaggagaaggaggtcgacgaggacacgacagtcacaatcccctcggccgtgtacgtggctcaactttaccaccaagttagtaaaattgagtgggattatgagtgtgagccagggatggtcaaaggcatccatcatggccccagtgtggcccagcccatccacctggacagcacccagctctccaggaaattcatcagcgactacctctggagtctggtggacaccgagtggtagccaggagcctcgtggctgcgtcttgcac

SEQ ID NO: 2952 - DNA, 2909 bp, Homo sapiens
aattccggaggcggcattcggtggtcagaggcctgtgcggctgcaggtagagtgtcttaggaacctaggaaataactcggaacctgtaacgtcccactggtttggacatattcctctcctgatctggcctcatctgttccagggaggtgggattgaaacatatgcagtaatgtcacctcaaaagagagttaagaacgtccaggcacaaaacaggacttcacaaggtagtagtagttttcagaccacgctttcagcctggaaagtaaaacaggatccaagcaactcgaagaacatctcaaaacatggacaaaacaatccagtgggagattatgaacatgctgatgatcaagctgaagaagatgctttgcaaatggcagtgggatattttgagaaaggtcccattaaagcttcacagaataaagataaaaccttggaaaaacacttgaaaactgtggaaaatgtggcttggaagaatgggttagcttcagaagaaattgatattctattaaatattgcactcagtggcaaatttggaaatgctgtaaacacacggatattgaagtgcatgatcccagcaacagtaatatcagaagattctgtggttaaggcagtctcctggctttgtgttggcaagtgttctggtagcaccaaggtacttttttatcgttggctggttgcaatgtttgacttcattgatcgtaaggagcaaattaacttgctctatggcttcttttttgcttcattgcaagatgatgcactgtgcccttatgtttgccatttgttatatttacttaccaaaaaagagaatgtcaaaccatttcgtgtgagaaaactgcttgatcttcaggccaaaatgggaatgcagcctcatctccaggctttgttgtcactgtataagttctttgctcctgctctgatttcagtatctttgcctgtaaggaagaagatatattttaagaattcagagaatctatggaagacggctctgcttgccgtgaagcaaagaaaccggggaccttctccagaacctctgaagttgatgttaggtccagctaatgttcgtcctctaaaaagaaagtggaattctctctcagttataccagtgctcaattccagtagctacactaaagaatgtggaaaaaaagagatgagtctttctgattgtctgaatagaagtggatcatttccactagaacaacttcaaagcttcccccaacttttacagaacatccattgcttagagctgccttctcagatgggctcagtgctaaacaactctctgctgcttcactacattaactgtgtcagagatgagccagtcttgctgaggttttattactggttgagtcaaacattacaagaagaatgtatttggtacaaggtgaataattatgaacatggaaaagaatttaccaacttcctggataccatcatcagggcagagtgcttcttacaagaggggttttattcctgtgaagcattcctgtataagagccttcctctctgggatggcctttgttgtcggtcacagttccttcagcttgtgagctggattccttttagtagcttctctgaggtgaaaccacttctttttgaccatctagcgcagctcttctttacatcaaccatttatttcaagtgtagtgtgcttcagagtctgaaagagctattgcagaattggctgttgtggctttctatggacattcacatgaaacctgttacaaacagtcctctagagacaactttgggtggatccatgaactctgtgtctaaactgatccactatgtagggtggctatccactactgcaatgcgcttggagagcaacaatactttcttgctgcactttattttggatttctatgagaaggtgtgtgacatatatataaattataaccttccattagtggtattgtttcctcctgggatcttctattctgcactcctcagcctggataccagcatcctgaaccagctgtgttttattatgcacagatatcgtaaaaatttgactgccgcaaagaaaaatgagttggtacaaaagacaaaatcagagttcaatttcagcagcaagacttatcaagaatttaatcactatttgacatcaatggttggttgcctgtggacgtccaaaccctttgggaaaggaatatatattgaccctgaaatcctagaaaaaactggagtggctgaatataaaaacagtttaaatgtagtccatcatccttctttcttgagttacgctgtttcctttttgctacaggaaagcccagaagaaaggacagtaaatgtgagctctattcggggaaagaaatggagctggtatttggactatttattttcacaggggttacaaggcttgaaactttttataagaagtagtgttcatcattcttccattcccagagcagagggcataaactgcaacaatcaatattaaatgaatgttgacataaactgaacacactggactaaactcactcctcattgctagagcaaagtggctcatcttgagttcccattttcatttcactgacagactgccatcctcaaggagtactcagactggccttctgttcatggcttaggagagccttggtgtgcctaactgatttttcaaaatttagatttttttagcctaccagtgaaaaatgaccccttcatcatcaggctctgcgttctaccaaattgtatgtaaaaagacacatctgttttgtggtaggattttttcacatttttgggtactatgagctgcattgatggaagacagcaggcaatatgtggtgacagttaactcacagacataaacatgcaaaatactttgctgtctctggggatattgccatttttcttactgtgagcaacagcaccaacaccaagttaacaggatgcaacatgtgtatgactct

SEQ ID NO: 2953 - DNA, 2594 bp, Homo sapiens
gcccagggatcagtgtctttcaatgatgtgactgtggacttcactcaggaggagtggcagcacctggatcatgctcagaagactctatatatggatgtgatgttggaaaactattgccacctcatctctgtggggtgtcacatgaccaaacctgatgtgatcctcaagttggaacgaggagaagagccatggacatcatttgcaggtcatacctgcttggaagaaaactggaaagctgaagactttttagtgaaattcaaggaacaccaagagaagtattctagatcagttgtaagcatcaaccacaaaaaactggtgaaggagaagagtaaaatatatgaaaagacatttactctaggcaaaaaccctgtgaattcaaaaaatctacctcctgaatatgatactcatggaaggattttgaaaaatgtttcagaattaatcatcagtaatctaaatcctgcaagaaagagacttagtgagtataatggatatgggaaatcactcctgagtactaaacaagagactactcatcctgaagtcaaatcccataatcaaagtgccagagctttcagtcataatgaagttcttatgcagtatcagaaaacggaaactccagcacagtcatttggatataatgactgtgagaaatcattccttcaaaggggaggcctgattacacatagtagaccttacaaaggagaaaacccatctgtatataataaaaaaagaagagcaaccaatattgaaaaaaaacatacatgcaatgaatgtgggaaatctttctgcaggaaatcagtattgattctgcatcagggaattcactcagaagaaaaaccctatcaatgtcatcaatgtggaaatgcatttagaaggaaatcatatctcattgatcatcagagaactcacacaggagagaaaccctttgtttgcaatgaatgtggtaagtccttccgcctcaagacagccctcactgatcatcagagaacacacacaggggagaaatcgtatgaatgtctgcaatgtaggaatgccttcagattgaagtcacacctcattcgtcatcagagaactcacacgggagagaaaccatatgagtgtaatgactgtgggaagtccttccgccagaagacaacactctctctacatcagagaatccatacaggtgagaaaccctacatttgtaaagaatgtgggaagtcctttcaccagaaggcaaatcttactgtacatcagagaactcatacaggggaaaagccctatatttgtaatgaatgtgggaaatccttctcccagaagacaacccttgctcttcatgagaaaactcataatgaggagaaaccctatatttgtagtgaatgtggaaagtccttccgccagaagacaacccttgtagcacatcagagaacacatacaggggagaaatcttatgaatgtcctcactgtgggaaggcctttagaatgaagtcatacctcattgatcatcaccgaactcacacaggagagaaaccatatgaatgtaatgaatgtggtaaatcattcagtcaaaagacaaatctcaatctacatcagagaattcatacaggggagaaaccctatgtttgtaatgaatgtgggaagtcctttcgccagaaagcaaccctcactgtacatcagaaaatacataccggccagaaatcctatgaatgtcctcagtgtgggaaagcctttagcaggaagtcatatctcattcatcatcaaagaactcatacgggagagaaaccatataaatgtagtgaatgtggaaagtgcttccgccagaagacaaatcttattgtacatcagagaactcacacaggtgagaaaccctatgtttgtaatgagtgtggtaagtctttcagttataagagaaacctcattgtccatcaaagaactcacaagggagaaaacattgaaatgcaataaatgatgtggtttcttatatgaattctttacaagctgttgtaaacatttagttttaaaaagaaaagcatgctgaaacatgttaatgtaattttaaatcacaagtctaataattattaaagtaccatacggaataactgtctactgtttactagcatataaaataagtatgatcattattattgaactctatcagctatgaagctaaattttaaagtcaactgctcttcctactgactcaaatagtttattttttaaaaatacttatataatacatgcagagacaagatacacaatgattataagtattaatctccataagagaaaatatttatgaactatatttctcattgcactctgtaataaaaagcagttagttgttacttacctaagagttaccacttccgtagcctataacatcaaaacgtagtttttgcatgttttcaattttataaatatatattttatcagacatcatgaattattttgtgtcttgcttatttcactcaattttttaagatctgtacattattgcatgtggcagtagtgtattttcattttgcatactattccattttaagaatatattgctgtttatcctattgatggatatttgtattttttatacttttgtgtaataataaaaatactgctgt

SEQ ID NO: 2954 - DNA, 1899 bp, Homo sapiens
aaaaagactttttttagaaaaaaatttcctcttgagccatcatgcacatctgactgcagccccagcgagcccttccttccttgtctgactgctcttcttctcgatttcttcttgttctgccttctcggtttgcagccctgacccccgctgtgtgtctggcccttggtgactgtccgtgtttctgttcctgtcattgtaactgtgacttttctctctgtctgcccccccttcctactggttcatgcttctcccccattcccaccctctctgcccggcctcccgctcccgccctttctcctcatgcacccggcctcgtctctgtagtctctgcacttgtctcccattaaggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgcgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagt

SEQ ID NO: 2955 - DNA, 859 bp, Homo sapiens
ctctggctgccttctcctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaagaaacttccaattgaagacactgagctgaaccattccgcccgcccgcccgcccgagggcactccagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgggctgtgcggagacacctgttcccccagcactcagcccctggccgaggtgtcgtctgggagtggctgagcgacgatggctcctggactgcctatgaagccagcgtctgtgactatctggagcagcaggtggccaggggcaac

SEQ ID NO: 2956 - DNA, 4529 bp, Homo sapiens
gtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttgatcagtactttggagattctaaatttggaagatcagggtgcacttctgagtgatgatgaaatatttgctagccgccaaactgggaaacatacctgcatggccttgcgcaaatactttgaggctcacctggccattaaattggaacaagtgaagcagtcacttcagaggactgagggtggcattcttgtccacccacaacccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcagagagaagaggggacaaatttggttgtgaagtaaacaagaaacacaagacggctaaaactctccaggggcaggtaaagccctgctgggctcagaagcactatagaatttgctgtacacactgaagtgggtctgtgtcacacaggtatttcttggtcctctggagagcagaggactcactcagctctttgcttcatgcctcgctttaatggtagtaaacacttaaccagtggaatagtctgactgctggtactgatggcatcagaagaaaacaggttaacaatcaagtagtgaaagcactatattctagtcattaactcaacggagccagtctcaactctgctgggagcacccacaggtctctgtgggggagacagggactataacagggaggcagaattcaggttggcttgacaacacaccttaggaacatgtgctaaggggctaaggaggcatcagctgtcttccttattctaccagggctgaaaatcggagtcacttaggaggcagcatgagaacagtggcacaccaccagtgaggcacatgttgcctttttgtctttaagcaacaccttagacagggcctgaaccctgggtgggggcactggatgcctgaagtaagtaagttttctcagtggggcagtctcataaaatcaccaggacattgaccacctgacctcccctaactagtgctggccaaggcctgagagttcacagaacctgctaggtcttaagagccaaaggaaggaagtggttgagggccaggaaagagaaggaatgtcatgccagggtgttactcctcaccaaaacttggcagttctttttggggccatgggacacctttctctgaagaggggttggataaggcaaaggttgaagtgtcttctctaggcacgttttctagcatgtttccttttacttggttctgtctcacaaagctgggaggtagatgattcttccgggtcctgagcacctgcttcatgaaggaagataggtagcccagagaagaagttttggacttaacaacataccaaggcagctctggcctgtgactcaggcgtttgttggagagctgcaggaaaaccactgcagtgtgcctgcaacaggacaagacccactcctgtttctggcggtaccagctaccctggaatggtggcgtgtcctgctgtacccaactgacttgcttaggtacctggcagctgtgaccacagctcaagtaaaaaaacaaaaacaggcaaataaataaacatgcttaacatgtc

SEQ ID NO: 2957 - DNA, 793 bp, Homo sapiens
gacaacaagatggcggcgctgcgggacggctagcggccctgcgtgtactttcccaagcaccaccaggccaaaggtctctcagttcagagcagaaagccgtatacccagaggagcaggcagataacagaaacttccagaaacctctgtggagacagtggaagaggcaaaagggagttcctgacagctggattctagaagtagaactatgagctcacctttggcctcccttagcaagacccgaaaagtgcccctgccctcggagcctatgaatcctgggaggcgaggaatccgcatctatggagatgagcggtgacctaggcatccctgtctgcagaagatgaggtggacatgttgagtgatgggtgtggctcagaagaaaagatctcagtcccttcctgctatggcggcataggtgcccctgtgagtcggcaagtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccag

SEQ ID NO: 2958 - DNA, 2643 bp, Homo sapiens
gcctgacgcggcgttgcgtcccccgggagctgcgctaggcgaacggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgacagtgttgagcaagaactcccttcctctccaaaacaacctatttgttttgatagacaatcgacattaaaaaaaagtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatgctaagcagtggtggagagaatatttgcaaattcgaccctcacacaactcacgactggttaagatttttgcacaggatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaagggtgactgtgaagatcacgctaaccttctgtgcagccttcttcttggatatggattagaagcctttgtttgtgttgggaccaaggcaaaaggagtacctcatgcatgggttatgacttgtggaactgatggggccatcactttttgggagagtttaacaggacacaggtacatccataaacctaccaatcctgatgaacctccagttgctgaacagcccaaaccactgtacccatatcgaacaattggttgtgttttcaaccatcagatgttcctgggaaattgtcaaccctctgatgcagtagaaacctgtgtatttgatttgaacgatgaatccaaatggaaacccatgagtgaggaagcaattaaatctgtgtgtgctcctggagctacaacatcccttcctccctttccacctctgtgtgcatccacaattgacgcgtcagtaacaagtaatgaaattgaaatgcagctgaggctcctggtgtcagaacacaggaaggatcttggcctcactactgtttgggaagaccagctctcctaccttttatcaccagctttggcttcttatgaatttgagcgtacaacaagtatatcagcaggcaatgaagaatttcaagatgccataagaagggctgtacctgatggtcacacatttaaagggttcccaatacattttgtgtatagaaatgcaagacgtgcatttgccacatgtcttcgatctcctttctgtgaagaaataatctgttgccgtggagaccaagtgcgactggcagttcgtgtccgagtatttacttaccctgaatctgcatgtgctgtttggatcatgtttgcttgtaaatatcgctcggtattatagggccaatatttatataagatttatacctgtgtttaattggaattttacacattgtacattacttagctatttagaggtttgttattttaaaatcacaatctggcttgaatggcatacttcaattttgtatatacttgactggtaatgtttaaaaaaaatcatgcattcctttaaaaattaaggctgaaaaacttgtataaatctccctggaatttagtataaattaagtgtatattctattttaataaatgctactttgtttacagttatcagtagtttaaatattaatataaaatgcattcagttttctttacacaaacaggtaatcaaagagatgtttgtctaagggtttgagccctagacaaatcagtatgatcattacttttcacaggttaatggaattattttatacagattaggagaaattaacctcatgacagatttatttattgcattggtgaaaataaatgttaatgaattaccacttttgtggtttattcgtggtccttgggatatttgagactgtccagaaatttatggttggaccttgaagcaagagtaggaaaaaactaataccagaaaagcataaatattaataacctcatatgaaagtacatgaatcatttagaaatatttatcactgtgatttgttgtaaaaatgaattgggtattttagaaaaactttattatacctctttgttatgatactgataaattgtgatcttgcagtcg

SEQ ID NO: 2959 - DNA, 5339 bp, Homo sapiens
acagtccctggtaaacacaagtagtattacaagtcgggagctcttcaagtcttggatgagactgtagagcggtcttgtgcggcaatgtgctaccttaaaataaataaataaataaacccctgttatgtccggagtttgtttccacccggagaggaatggaagagcaccagagagcgcttagctttctggttggatgttttgggttcatcagacttaacttctgctagaaattgttaccagcctctattagaaaatcccatggtgtcagaaagtgatttttctaaagacgttgcagtgcaagtgttgcctttggataaaatagaagagaacaacaagcaaaaagcaaatgacatcttcatttctcagtatacaatgggacagaaagatgctctaagaacagttttaaagcaaaatgtctcactttgtctcacaggctggagtgatcacagtggggtgatcacaactcactgcagtctctacctcctcaggctcatgagatcctcccacctcagcctcccgagtagctgggactacagagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcagactcattttattagtgctgcactcaagactagtagttttcagcctgttagtatgccctcctccagagcagtggaaaagtattccgtaaaaccagaacaccctaatcttggtagctgtaatccatctttatataacacatttgcttccaaacaagcacctttaaaagaagttgaagatacgagttttgataaacagaaatctcctttggagacaccagcacctcgcagatttgctcctgtacctgtttcaagggatgatgaactatcaaagagggaaaatcttttggaagaaaaagaaaatatggaagtgtcgtgtcacagaggaaatgtaagactattggaacaaattttgaataataatgattctttgacaagaaaaagtgaatcatcaaacaccacctcactaactaggtcaaaaataggatggactcctgagaaaacaaacagatttccttcctgtgaagagctagaaacaactaaagtgactatgcagaagtctgatgatgttcttcatgaccttggccaaaaagagaaagaaacaaatagcatggtccagccaaaagaatctctgagtatgttgaagcttccagatcttccacagaattctgttaagcttcaaacaaccaatacaacaagatctgtattgaaagatgctgagaagattttgagaggagtacaaaacaataaaaaagtacttgaagaaaacctggaagctattattcgtgcaaaagatggagctgccatgtattcgcttatcaatgctttatctaccaacagagagatgtcagagaaaattaggatcagaaagacagtggatgaatggattaaaactatttctgcagaaattcaggatgaactgtcaagaacagattatgaacaaaaaagatttgatcagaagaatcagagaaccaagaaaggtcagaatatgactaaagatattagaaccaacacacaagataaaactgtcaacaaatctgtaattccaagaaaacattctcaaaagcaaatagaagagcattttagaaatctacctatgaggggcatgcctgcttcaagtttacagaaagagagaaaggaagggcttttgaaagcaaccacagtaatacaagatgaagattatatgttacaagtctatggaaagccagtttatcagggccatcgaagcactcttaaaaaaggaccatatctcagatttaattctccatctcctaagtccagaccacagagaccaaaagtaatagaacgagttaaaggcactaaggtaaagtcaataagaacacagactgacttctatgcaacaaaacctaagaagatggattctaaaatgaaacattctgttcctgtgttacctcatggcgatcagcaatatttgttcagcccaagtagagaaatgcctactttttcaggtacattggaaggtcatctgattcctatggcaattcttttaggacaaacccaaagtaatagtgataccatgccacctgctggagtgattgtcagcaagccacaccctgtaactgtgactacttctattcctccatcatctcgaaaagtagaaactggagtaaagaaacctaacatagccattgtagaaatgaagtcagaaaaaaaggatcctcctcagcttactgtgcaggtattacccagtgtagatattgacagcatttcaaatagtagtgctgatgtcctttcacctctgtctagccccaaagaagcatctcttcctcctgtgcaaacttggataaagactccagaaattatgaaggtagatgaagaagaggtgaagtttccaggaactaactttgatgaaataatcgatgtcatacaggaagaagaaaaatgtgatgaaattccagactctgaaccaattctggagtttaacagaagtgttaaagctgattctacaaaatataatggtcctccatttccgccagttgcttctacttttcagcccactgctgatattctggataaagtaattgagagaaaagaaacactggaaaatagcttaattcaatgggtagagcaagaaataatgtcaagaattatctctgggctctttccagtccagcaacagattgcacctagtatcagtgtttcagtcagtgagacaagtgaaccactgacttctgacattgtggaaggaacaagcagtggcgccctccagctttttgttgatgctggtgttcctgtgaactcaaatgtgattaaacattttgttaacgaagctcttgctgagaccattgctgtcatgctgggtgacagagaagcaaagaagcaaggtcctgttgctacaggtgtttctggggatgcttcaacaaatgaaacatatttgccggcaagagtgtgcaccccactgcctaccccacagcctacgcctccttgctcaccttcatcacctgctaaggagtgtgttttggtaaagactccagattcttctccctgtgattcggatcatgatatggcttttcctgtgaaagaaatatgtgctgaaaaaggagatgatatgcctgccatcatgcttgttaatactccaacagttacccctactactacacctcctccagcggcggcagtttttaccccaactttgtcagatatttccattgataaattgaaggtatcaagcccagagcttcccaagccatggggtgatggagacctgccactggaagaagagaaccctaactcacctcaagaagaacttcatccaagagctattgtaatgtctgtggctaaggatgaagaaccagagagtatggatttccctgctcagcctccacctccagagccagttccctttatgccatttcctgccggcaccaaggccccttccccctcacagatgccaggttctgattcatcaacactggagagcacattgagtgttactgtcactgaaactgaaactttagataaacccatctctgaaggagagattttatttagctgtggtcaaaaattggcccccaagattttagaagatataggactgtacctgacaaaccttaatgatagcttatccagcactctgcatgatgccgttgaaatggaggatgatcctcctagtgaagggcaagtgattaggatgtcccataaaaaatttcatgcagatgcaattctttcttttgctaaacaaaaccaggagtcagcagtttcccagcaagcagtctatcattcagaggacttggaaaacagtgtgggtgaacttagtgaaggacaaagaccccagctaacagcggcagcagagaacatcttaatgggacattctctctatatgcagccacctgtcactaatacacagtctttggatcaacaatgtgatcctaaaccattatctcggcaatttgacacagtttcaggtagtatttatgaagattcatgtgctagtcatggtccaatgagtttgggagaattggagttggagccaaattctaagctggttcttcccacaacacttctgacagcacaagaaaatgatgttaatttaccagtagccgctgaagatttttcccagtaccaactaaagcaaaatcaggatgttaagcaagttgaacacaaaccatcacaaagttacctacgtgttagaaataaatctgatattgcaccttcacagcaacaagtttcaccaggtgatatggatcggacacaaattgagcttaatccgtacctcacatgtgtattttcaggtgggaaagcagtgccactctccgcttcacagatgccccctgccaagatgtcagtgatgctgccgtcagtgaacctcgaggactgctctcagtctctgagtctcagcacaatgcaggaggacatggagtcttcgggggcagataccttctgaacgggaagagacagccagcacagtgtttatgccactggttttaaagtcattttaccttggcttaaaaccctctctcagactgtttggtttttgagcatattctgaaaaaaaaattccaatattttaaaataaaacaaaaagcataatttgggtatttaaagtttttaaataaaataagtataagtcattataagtctgattgtgagttgtttcttagaatcctgagatagcatagagtagtgaaagggcatggcttttgacatctaggcatttaatctataggtgtaattatctgtatgtatttataaaattatgtagctcaaggttattcattctaacatttttataacagcaaatagaaaaaatcaaatgtctatcaataatagactggttttaaagtgatggtacatcagtacaatggaatactatgtattacaaaaaaaaatttaaaaagtttattgatatggaataatctttgagatgcactgttaaagtgaaaaaagccatgtgcaaaatagtgtgtgaactatgcagttgttgaaattatttaaaatggggtggggagg

SEQ ID NO: 2960 - DNA, 2385 bp, Homo sapiens
gcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaaggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataa

SEQ ID NO: 2961 - DNA, 524 bp, Homo sapiens
gtgcgcccttccccgcgcgcggcccctcctgctgggctggggtctgtggctgacgtccgcttttcccggaacggcaaagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcaggtgtcaacctagatggaaagaagattttg

SEQ ID NO: 2962 - DNA, 1124 bp, Homo sapiens
acggggcggggacgagctgtcgcgctggttgctcgtgcaggagcgggacccggaacagaccgccgtgagagaggaggggcgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagc

SEQ ID NO: 2963 - DNA, 1868 bp, Homo sapiens
tttggtgctcaagagaggcttggaggagaccacagttctttctccatgtgtgaggaattaaaggcaactgtgcagaaacacacgcagagcctgaagcccagcaaggaggatctgaacaggcttaatcaggccatccagtggctgacggtggaggtgggcagtgctgagagtcagcaccatgacttgtggatcttactgtggtggccgcgccttcagctgcatctcggcctgcgggccccggcccggccgctgctgcatcaccgccgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcaggttcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaaatcagacctggaggccaatgtggaggccctgatccaggagatcgacttcctgaggcggctgtatgaggaggagatccgcgttctccagtcccacatctcagacacctccgtggttgtcaagctggacaacagccgggacctgaacatggactgcatcattgccgagatcaaggcacagtacgatgacattgtcacccgtagccgggctgaggccgagtcctggtaccgcagcaagtgtgaggagatgaaggccacggtgatcaggcacggggagaccctgcgccgcaccaaggaggagatcaacgagctgaaccgcatgatccagaggctgacggctgaggtggagaatgccaagtgccagaattccaagctggaggctgcggtggctcagtctgagcagcagggtgaggcggccctcagcgatgcccgctgcaagttggccgagctggagggtgccctgcagaaggccaagcaggacatggcctgcctgatcagggagtaccaggaggtgatgaactccaagctgggcctggacatcgagatcgccacctacaggcgcctgctggagggcgaggagcagaggctgtgcgagggcgtcggctcggtgaatgtctgcgtcagcagctcccgcggtggcgttgtctgtggcgatctctgcgcctccactactgcccctgttgtctccaccagagtcagtagcgtccccagcaacagcaacgtggtggtgggcactactaacgcctgcgccccctccgcccgggttggcgtctgcggcggcagctgtaagaggtgctaggaggctgccgcctccgccagcgcctgtcgccgtcactctccacccagccagtacctcgcgccaccagaacgcgccgcccgcgccggcctcccaatagccgccgcccgctgcctgcactctaagcgccctccccaccgctccgctccgggagccatccccggtcgcaggagtccggggagggccgggaggcgccatggtctctctctgtagcctttcctggtagtcaatt

SEQ ID NO: 2964 - DNA, 2238 bp, Homo sapiens
atggctctgctgtccgagggcctggacgaggtgcccgccgcctgcctgtcgccgtgcgggccgcccaacccgaccgagctgttcagcgagtcacggcgcctggctctggaggagctggtggcgggcggccccgaagccttcgcggccttcctgcgacgcgagcgcctggctcgtttcctgaaccccgatgaggtgcacgccattctgcgcgcggcggagaggccgggagaggagggcgcggcggcggcggcggcggccgaggactcgttcggctcctcgcacgactgctcttcgggcacctacttccccgagcagtcggacctggagccaccgctgttggagcttggctggcccgccttctaccagggcgctggcgaaggtggcccctacggctgcaaggacgctctgcgccagcagctccgctcggcgcgagaggtgattgcagtggtcatggacgtgttcacagacatcgacatcttcagagacctgcaagaaatatgcaggaaacagggagttgctgtgtatatccttctggaccaggctctcctctctcaatttctggatatgtgcatggatctgaaagttcatcctgaacaggaaaagttaatgacagttcggactatcacaggaaatatctactatgcaaggtcaggaactaagattattgggaaggttcacgaaaagttcacgttgattgatggcatccgcgtggcaacaggctcctacagttttacatggacggatggcaaattaaacagcagtaacttggtaattctgtctggccaagtggttgaacactttgatctggagttccgaatcctgtatgcccagtccaagcccatcagccccaaactcctgtctcacttccagagcagcaacaagtttgatcacctcaccaaccgaaaaccacagtccaaggagctcaccctgggcaacctgctgcggatgcggctggctaggctgtcaagtactcccaggaaggcggacctggacccagagatgcccgcagagggcaaggcagagcgcaagccccatgactgtgagtcctctactgttagtgaggaagactacttcagcagccacagggacgagctccagagcagaaaggccattgacgctgccactcaaacagagccaggagaggagatgccagggctgagtgtgagtgaggtgggaacacaaaccagcatcaccacagcatgtgctggtacccagactgcagtcatcaccaggatagcaagctctcaaaccacgatttggtccagatcgaccactactcagactgacatggatgagaacattctctttcctcgaggaactcaatctacagaagggtcaccagtctcaaaaatgtctgtatcgagatcttccagtttgaagtcttcctcctctgtgtcttcccaaggctctgtggcaagctccactggttctcccgcttccatcagaaccactgacttccacaatcctggctatcccaagtacctgggcaccccccacctggaactgtacttgagtgactcacttagaaacttgaacaaagagcggcaattccacttcgctggtatcaggtcccggctcaaccacatgctggctatgctgtcaaggagaacactctttactgaaaaccaccttggccttcattctggcaatttcagcagagttaatttgcttgctgttagagatgtagcactttatccttcctatcagtaactgctccgtgttcagactcctggtttcttccaggcttacagtggacatcatcagcttcctgctttaaaaaatatcttatgtccctaattgcctttcttttacctgactttgtcacctttgttgtctttgaattctttaggctgcatattattttacatgctttgttttgtcatgtatataccaggtattggttttatggtttaaacactatggatacaggggtttgttttgcacaattttaatagtcatgcactacataatgatgttttggtcaatgacagaccacgtatatgttggcagtctcataagattataatactgtatttttactataccttttctgtgtttagatacaaataccattatgttacagttgcctacagtattcagtgcagtaacatgatgtacaggtttgtagcctgttttgcatttttcttaggttgtatgctcttctgttttaaaggtttgaatcaccagcatttttgtgatcaaaatcctatttagaaaaaataaaactactttctgttt

SEQ ID NO: 2965 - DNA, 10861 bp, Homo sapiens
cgccccccctgcgcccgcccctcccccttcgctttccttctccccccgcctcggctccgacatgaggggccggcggggcaggccgcccaagcagcccgcggctcccgctgcggagcgctgcgccccggccccgccgccaccgccgccgccgcccacgtccggacccatcggggggctccgctcgcggcaccgcggcagcagccggggcaggtgggccgccgcccaggctgaggtggcgcccaagacgcggctgagctcgcccagggggggcagcagtagccggaggaagccgccgccgccgccgccggccccccccagcaccagcgccccgggccggggggggcgaggaggcgggggcggcaggacggggggcgggggcggcggcggccacctggcccggaccaccgcggcccggagggccgtcaacaaagtggtgtacgatgaccacgagagcgaggaggaggaggaagaggaggacatggtctccgaggaggaggaggaggaggacggcgacgccgaggagacccaggattctgaggacgacgaggaggatgagatggaagaggacgacgatgactccgattatccggaggagatggaagacgacgacgacgacgccagttactgcacggaaagcagcttcaggagccatagtacctacagcagcactccaggtaggcgaaaaccaagagtacatcggcctcgttctcctatattggaagaaaaagacatcccgccccttgaatttcccaagtcctctgaggatttaatggtgcctaatgagcatataatgaatgtcattgccatttacgaggtactgcggaactttggcactgttttgagattatctccttttcgctttgaggacttttgtgcagctctggtgagccaagagcagtgcacactcatggcagagatgcatgttgtgcttttgaaagcagttctgcgtgaagaagacacttccaatactacctttggacctgctgatctgaaagatagcgttaattccacactgtatttcatagatgggatgacgtggccagaggtgctgcgggtgtactgtgagagtgataaggagtaccatcacgttcttccttaccaagaggcagaggactacccatatggaccagtagagaacaagatcaaagttctacagtttctagtcgatcagtttcttacaacaaatattgctcgagaggaattgatgtctgaaggggtgatacagtatgatgaccattgtagggtttgtcacaaacttggggatttgctttgctgtgagacatgttcagcagtataccatttggaatgtgtgaagccacctcttgaggaggtgccagaggacgagtggcagtgtgaagtctgtgtagcacacaaggtgcctggtgtgactgactgtgttgctgaaatccaaaaaaataaaccatatattcgacatgaacctattggatatgatagaagtcggaggaaatactggttcttgaaccgaagactcataatagaagaagatacagaaaatgaaaatgaaaagaaaatttggtattacagcacaaaggtccaacttgcagaattaattgactgtctagacaaagattattgggaagcagaactctgcaaaattctagaagaaatgcgtgaagaaatccaccgacacatggacataactgaagacctgaccaataaggctcggggcagtaacaaatcctttctggcggcagctaatgaagaaattttggaatccataagagccaaaaagggagacattgataatgttaaaagcccagaagaaacagaaaaagacaagaatgagactgagaatgactctaaagatgctgagaaaaacagagaagaatttgaagaccagtcccttgaaaaagacagtgacgacaaaacaccagatgatgaccctgagcaaggaaaatctgaggagccaacagaagttggggataaaggtaactctgtgtcagcaaatcttggcgacaacacaacaaatgcaacttcagaagagactagtccctctgaagggaggagccctgtggggtgtctctcagaaacccccgatagcagcaacatggcagagaagaaggtggcatctgagctcccccaggatgtgccagaagaacctaacaagacatgtgagagcagtaacactagtgctaccactacctccatccagcctaatctggaaaacagtaacagcagcagtgaactaaattcttcccagagtgaatctgctaaggcagctgatgatcctgaaaatggagaaagagaatctcatacacctgtctctattcaggaagagatagtaggtgatttcaaatcggagaagtccaacggggagctaagtgaatctcctggagctggaaaaggagcatctggctcaactcgaatcatcaccagattgcggaatccagatagcaaacttagtcagctgaagagccagcaggtggcagccgctgcacatgaagcaaataaattatttaaggagggcaaagaggtactggtagttaactctcaaggagaaatttcacggttgagcaccaaaaaggaagtgatcatgaaaggaaatatcaacaattattttaaattgggtcaagaagggaagtatcgcgtctaccacaatcaatactccaccaattcatttgctttgaataagcaccagcacagagaagaccatgataagagaaggcatcttgcacataagttctgtctgactccagcaggagagttcaaatggaacggttctgtccatgggtccaaagttcttaccatatctactctgagactgactatcacccaattagaaaacaacatcccttcatcctttcttcatcccaactgggcatcacatagggcaaattggatcaaggcagttcagatgtgtagcaaacccagagaatttgcattggctttagccattttggagtgtgcagttaaaccagttgtgatgctaccaatatggcgagaatctttaggacataccaggttacaccggatgacatcaattgaaagagaagaaaaggagaaagtcaaaaaaaaagagaagaaacaggaagaagaagaaacgatgcagcaagcgacatgggtaaaatacacatttccagttaagcatcaggtttggaaacaaaaaggtgaagagtacagagtgacaggatatggtggttggagctggattagtaaaactcatgtttataggtttgttcctaaattgccaggcaatactaatgtgaattacagaaagtcgttagaaggaaccaaaaataatatggatgaaaatatggatgagtcagataaaagaaaatgttcacgaagtccaaaaaaaataaaaatagagcctgattctgaaaaagatgaggtaaaaggttcagatgctgcaaaaggagcagaccaaaatgaaatggatatctcaaagattactgagaagaaggaccaagatgtgaaggagctcttagattctgacagtgataaaccctgcaaggaagaaccaatggaagtagacgatgacatgaaaacagagtcacatgtaaattgtcaggagagttctcaagtagatgtggtcaatgttagtgagggttttcatctaaggactagttacaaaaagaaaacaaaatcatccaaactagatggacttcttgaaaggagaattaaacagtttacactggaagaaaaacagcgactcgaaaaaatcaagttggagggtggaattaagggtataggaaagacttctacaaattcttcaaaaaatctctctgaatcaccagtaataacgaaagcaaaagaagggtgtcagagtgactcgatgagacaagaacagagcccaaatgcaaataatgatcaacctgaggacttgattcagggatgttcagaaagtgattcctcagttcttagaatgagtgatcctagtcataccacaaacaaactttatccaaaagatcgagtgttagatgatgtctccattcggagcccagaaacaaaatgtccgaaacaaaattccattgaaaatgacatagaagaaaaagtctctgaccttgccagtagaggccaggaacccagtaagagtaaaacaaaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccaccacgggaggcacactggttacatctatgactgtgagcaaagagtattccacacgagacaaagtgaaactgatgaaattttcaagaccaaagaagactcgttcaggtacagctctgccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacagaaacatccgaaactgaaatcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtggtgatgaagcataatgctgtaatagaacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggaagagctgaagagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaaattttatattggctgtgatcggtgtcagaattggtaccatgggcgctgcgttggcatcttgcaaagtgaggcagagctcattgatgagtatgtctgtccacagtgccagtcaacagaggatgccatgacagtgctcacgccactaacagagaaggattatgaggggttgaagagggtgctccgttccttacaggcccataagatggcctggcctttccttgaaccagtagaccctaatgatgcaccagattattatggtgttattaaggaacctatggaccttgccaccatggaagaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcaggtctcataacaacaaactgcagtctacagcttcttaaagttcagcgtgttaacctaacataaaacacagcaagaatctggttgtctgaactattttaaattaaggagccagatgtttttagtcaggctatcctgacaagacttgacctaaacttcgtttttattggtcataacagtccaattatattcttggccaattttgtccaacggacaagaaaaaagcaaagtcaacgacaccattatcttgtcaagatcagatggttttactattgtggcagaagcgagaaaactttgtttattgaaaaaaaaagaaaaagaaagcaagaaaaaaagatactatggggtcaagtgtaactccatggaaatgccacgtctgctcttcagtgaagaagctggtttagagtctcacagaaaacttttgactgtatttatttattgttgcaaaaaagacgcttttttattgctgccctcatttgtcagctaattattttttcttataaaatccagccccggttacatataatcatctgtatcttatcatgattcctgtaggtaaaagtacaagacgacctctagatgtcttttctttctatgaaaggagctgctatgtacacatgtgcacacacacacaactgggaatcaacaatgagtttattgttcatggtagattaaaattaagcttgcataaaggttgggctaagtggtcctggactacagactctgttgccttgaatataacagtacaatttgtcaattactctgcaccaggctaaaatgagtaaaatctatttgaaggtatcttgtttgtaaacatttgtcagattctaatttttttcttttgtattaaaattcaactatggatgtatatgaaacaaaataaatggagataatttttctcccacagacagaggtgtctttgaatgtgcgctaatgattatctgtaagcctttgtggggagggaggcctgcaaggtcatgaaaggcagaagagtctaattgtgcctggatttctccaggacagcagtggcccctcgttttatcattcccagtccattgtcatcacgtcagagaaaaatcttcaggggtgctaatcctgttgcatcagttgatcatactaacgagaacggtaatgcgacaagatacacattgccttcatctgtacattctgtgataccaggcaaattaccaattacacacagctacttatattttatgaagggcattttttagatgacctcatcctctgtgttatttgttgattgggtttgttttctgtttgttggtttgtttgtttcttccacgtaaggaaaagtagtgtaaacagtagcgagaaaatggaaaccacagaggaagatgtattttgcatgtttttcctttcagtgttcttacacgttgtatcactgcattgtggtaatagcttctataaaatctgccatagttggattatgcagctttgcaaaaatttttactagattttgcactaactcatattagctttgtcctaccaacttctggaatttatctaattattgtttttcaaagtttctttccttttaatgtttccctgctatgcaaaacctttcccagacctcagtttcttaaaagaaagatgttgctacagttcccgattctttcttattacaggctcaggtgtacaggttattctgggttaattttatctaatgaagcccattcctttttgtacataaagatgtcacttaaacttatgcttacaaactaaagactaatcgctcaatatgaaaacatgaaaaaatttttgcttaaagtattaagatggaagtagttaaatatgggttattttgtccttttacttttttaaaaaatgttacatattgtatgcactgtgctgatgcaagaattctacattttaatgagttataaaattattctgcatctcatcacgtcacagtatttctgtactatttattcatatatataaatatatatgggcttaatcatttaaaatttgttgcagcaagaactttcctacctgtaggcaatagattgctatgtttttaacaaattgtggcaaattctaaacagcaattcttttgtacgtaataggacatttcatcctagaaaaataaagtaatgtttttgacattgga

SEQ ID NO: 2966 - DNA, 682 bp, Homo sapiens; identical to SEQ ID NO: 2784

SEQ ID NO: 2967 - DNA, 1738 bp, Homo sapiens
aaagttccgggtgaggcgtgggtcccacaaccgcttggaatttgcctcccggctccgctctggaagctaagaaggggcacgagagccggagacgggaacctgagagcagggaagccagtagccggccggaggagcgcgcggccgctccagtcggaaggagccgttgcagccctgcccggcgtgtggcggggtcagcgaggcccctgcggtgcttcgcccgcgccttccgctccgcactcacccgccctctgggcctcccacaggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaaggtgcgacagctctggtcagaagactcctgcgaatctgactccctgcgacaaggactgtgtactgcatgaatgaggctgagatagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatg

SEQ ID NO: 2968 - DNA, 577 bp, Homo sapiens
ttctttccagggaagaagggcggggatgtcagggctggagagtgcccgtgtccttctgtgtgcattgggctccttcctccttaattctctgctttccacttttaggctgaactccagtgcacccagttagacttggagcggaaactcaagttgaatgaaaatgccatctccaggctccaggctaaccaaaagtctgttctggtgtcggtgtcagaggtcaaagcagtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagtaagcaggagctggagacgatggcggccatcagcaacactgtccagttcttggagaggagtatgacatcagaactcaagtgtctgccattgttcagcgcaaatattggacttccaaacctgagcccagcaccagggaacagttcctccaatatgtgcatgacatcacgttcgacccggacacagcacacaagtatct

SEQ ID NO: 2969 - DNA, 1162 bp, Homo sapiens
cccaaacagagcgttttctggtccccgagctcctcccgaccccacccgctcctacggcctccaaccggccccccccaggtgtgtgcagtggcctcagggatccggaaagtctaggactgaacttctcctaacatccagtaatggggacctggaacctgggcttactagagtgccgcgcgtagggctccaggtcgctggcttctgcgcttccttcctctccaaagttgagtatctcctatctgtgtcctcgtacatactgccgcctgaggtgccatggcccccaagccgggggccgagtggagcacagccctgtcccatctggtgctgggagtggtgtctctgcacgcagccgtgagcacagccgaggcaagtcgaggggctgctgctggcttcctgctccaggtcttggctgccaccaccacgctggccccagggctgagcacacacgaagactgccttgctggagcctgggtggccaccgtcatcggccttccccttctggccttcgatttccactgggtgaatggggaccgctcctctgccaacctgctcctgggaggaggcatggtgctggcagtggctggcggccacctcggccctgagggccgctctgtggctggtcaggcaatgctgttggtggtcgcagtgaccatcctcattgtagctgtcttcacggccaacacttatgggatgtgggggggggcgatgctgggtgtggcaggcctcctgagccggctggaggaggacaggctgctgctgctaccgaaggaggatgtctgtcgctgggccttggctgtaggcagctgggcttactgccgggccctgcatacacagcgcctccagtgggagtgacagttggatacagccaggcagggtttctgccctgccgaacactttccctcccacctgcctgctcctggcgccttctccctaggggtagactcttctgcctactgaagtgggtttgctgcacattgactggtcaggggcagagtctgggtgctgtcctttggccacgtgtggggacttgtctagaccagaatgaaagggacagggtcccagacacgtttgggggtcctgattctgggctggacacggttgtggatccagagaagaggcctagtctccaataaatcttaggaattttgcaggaatatgaaaa

SEQ ID NO: 2970 - DNA, 1725 bp, Homo sapiens
gaataagcccgagcagccggtcctccagtggctccgctccccgttctctgtgggctcaaaatgacagaggctcacaggacacctgcatgcccaaggcactccaccgtatgtgatcaacctggatccagcagtacatgaagttccctttcctgccaatattgatattcgtgatactgtaaagtataaagaagtaatgaaacaatatggacttggacccaatggcggcatagtgacctcactcaatctctttgctaccagatttgatcaggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatcttatacaaaaccaagctgcctttcattgtggtcatgaataaaactgacatcattgaccacagctttgcagtggaatggatgcaggattttgaggctttccaagatgccttgaatcaagagactacatacgtcagtaacctgactcgttcaatgagcctggtgttagatgagttttacagctcactcagggtggtgggtgtctctgctgttctgggtactggattagatgaactctttgtgcaagttaccagtgctgccgaagaatatgaaagggagtatcgtcctgaatatgaacgtctgaaaaaatcactggccaacgcagagagccaacagcagagagaacaactggaacgccttcgaaaagatatgggttctgtagccttggatgcagggactgccaaagacagcttatctcctgtgctgcacccttctgatttgatcctgactcgaggaaccttggatgaagaggatgaggaagcagacagcgatactgatgacattgaccacagagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactcttccaagcctacaacttcaagttttatcatttgaactcaagtacttttgctgctgaggaatggaatcaaaagaacgtagtctcctggtgaccacctcagatctctattattaggctagatgtatagcctctactcccccagcttcttgctcttgaccctgcactgtaagttgcccttctattagcagccaaggaaaagggaaacatgagcttatccagaacggtggcagagtctccttggcaatcaaccaacgttgctatgaaatatgcctcacactgtatagctcattataggacgtcaggtttgttgaaaaaagtgggcaagacatgattaatgaatcagaatcctgtttcattggtgacttggataaagactttttaatttt

SEQ ID NO: 2971 - DNA, 4054 bp, Homo sapiens
actgcctttccaggatttattgcgaggatggagggaggcgcaggcgttctcattcatagttctcccatcctgaaagttctgttcctcttttgtccagaaactgggccctcgtcagactgccttgccctgttcctgactcaggccaaggcctgcagccgggaagaggttggggcggcgtgagttatgtgaaaagcgctcagaatacagtatgtcatgtaagaagctgaaagtgtatttatggagctagaggacaatgctgtccttccctggcacaagtgggcgtccgaagttggatttttcaaaaagaagaccccggccagtaaaaagtcaccaaataacaaaaccccaaaacttctgcagcgcttggcacatcttgtttattcagtaagctttagggattaaaaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtcaattatattccagaagtgagaatcatgtcaattcccaaccttcgctacatgaaggagagccaggtcctcctgactcttacaaatccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaaaaggttccactggagggcagatcccaaaggacagtatcaccgtaaacctgcgttaaaatgtggaagctgctgcttcattaggccttgtttataacgatgtacccatgcactacggaattctattgctaagaaagtgggagcataggcaaggcattgggaacacagggtagctgctgttgctcttgctctcacccctgttgacaccagtaagtctgtgtctccctcactgaaccctgcacgttgagtaacagcagcataattccatcctaggaaaggggatgggtgttccttggaatggcattgtatttaccacctgagaaactctgtactgtctcttgatctgatctcactaaggatcacaatgtcacagatgaaacttaaatgataacccaaaggtagacctgctgttaatgatccagcattggtcacaatgtaccaactgctttctgcattccgttaaatatcatctaacagtctaaaacatatcccttcattgccataatggctgccattttgccatagatttccatataactgaaaaactgaattgtcactttatctttagtatcatgatgattggaaaaacctgtgaagttgttaaggcactctcatttgccctctttttctaagtgaatacaggacacgtattagttgttcttaatttttttcccagtaaaatatggatcttttaagaagaatttgagaagcaaacaattacatgtcatgtcaagggggtagcagattccattcgttttcaatattgccacaatacccagggattaatgctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttgtttaccttggtcttgttttaagtcttaaaaaattaaagataacattataatgtagaatacagatgggacatagtccttgtaagcttcccttgaaaatgttttaaatatttaggaagcttttaaaagacactaaattgtactctaaaagacactaaattgtactaattgtacaaaggtcaagccaattttatgaaacagtcctacagagtaatatatgtgatgcagtgtaagaaggaaaatactcatctctaacattatggtaataacatttagcctcttaggagttggagcagggggatgggtaattacagatttgcagactatagaaagagtttcatttttttgtgaccccacagagtctcaaatttttatttcactacctgctagagcctactgtgaaatcactgctccatatttgccagtggaggaaatgggcatagagtagagaatagcttcatatgtttacacgtttgcatagactacacacatgtcatgcgtttatggcaggtagctggtatttattccccaaagtaataatgttgaagtatgggtctcatcattcccatacacagaaacacaaaacactttgatcataaacttttttcttcagaagccaaactaacttgcagaataatagagccactggtttaatgtttcctcaagataggttttagtgtaagctagtattctgtgtgttcgtagaaatgattcaatacctgcagctggtgaattaggaattgtatttgttgccttttttatattagatgaggtgcaaaaattttaatgctagtcagtatgcaccaccacaggaaagttagatcccattagcacttgaaactacagctttggaaacttaggctaagttaatttggatttgttacttgattcacctactgaccttttcttttgtttgaagtgcttatcagcataatgagctaagtgtcatgcatatttgtgaagaaacaccctttttggtcccttttgggacagagaggtactccttgatctttatgaatgacaggttactgttttgccttattgcttaacttaatgtagtgaaataaagcagacaaagcttg

SEQ ID NO: 2972 - DNA, 3058 bp, Homo sapiens
acgtcagagggtcgcgccgctgcaggaacccgctctgcctgagctaccgcgagtcgtagaaaattacgtaatgatagggggccggtcagagtgagggcacctgaggtacacgaaatccctccggcttgcccacttcctcggactttccaccaatcaggagcttcctccccagcaccaaccaattgtgggagagaagttttctctgtgctacaagcccggaatttcattcatacccagctacgctccgaatgagggagcagaggtacagcggccgaatgagcgggaacagttattccacgacaggtgtacatcagacgcattgcttaggcctcttattttacgttctccaagcaactccataagacaactgtctcggaaaggctacagtgatgacagaccgacttaagttcggattcggcttccaccgcttcttagtggtatgcaaagaagccttttcaccctgatgtccttagagataatatggatcagtccagagttctcctctgggtgaaagcagaaccctttatagtgggtgccttgcaggtcccccctccatccaagtttagtcttcactatctcaggaagatatccacctatgtgcaaatccgggccacagaaggagcttacccgcgcctctactggtctacatggaggcacatcgcttgtgggaagctgcagttggccaaggacctggcgtggctttacttcgaaatatttgatagtctttcaatgaagacacctgaggagcgcctggaatggtctgaggttctgtccaactgcatgtctgaggaggaagttgaaaagcagagaaatcagctttcagtggacacgctacagtttctgctcttcttatacattcaacagttgaacaaggtctccctaaggacatctttgattggcgaagagtggcccagtcccagaaacaaatctcagtctcctgacctgactgaaaaatctaattgtcataataagaactggaatgattacagtcaccaagcttttgtctatgatcatctgtctgatctcctcgagctgcttttagatccaaaacaactcactgcatcatttcattcaacccatagtagtctagtgtctcgagaagctgttgtggcgctcagcttccttattgaaggtacaataagtagagccaggaagatctatccacttcatgaacttgcactgtggcaaccactgcatgcagatagtggcttctcaaagatctctaagactttctctttctacaaactggaaacctggttgaggtcctgtttgactgggaatccatttggtacatcagcttgcctcaagtctggaaagaaattggcttgggctcatcaagttgaagggaccaccaaaagagctaagattgcttgtaatactcatgtggcccctaggatgcaccgactggtagtgatgagccaggtttacaagcagacactggctaagagctcagacactctggcgggggcacatgtaaagattcatcgttgcaacgaatcttttatatatctgctctctcccttacgatctgtgacaattgagaagtgcaggaatagcatctttgtcttgggccctgtagggactacacttcacctccacagttgtgacaatgttaaagtcattgctgtttgccatcgtttgtccatctcttctacaacaggttgcatctttcacgttcttacgcctacacgcccacttattctctctgggaaccagacagtaacttttgccccttttcatacacattacccaatgctagaggaccatatggccaggactggccttgctacagtgcctaactattgggataatccaatggttgtgtgcagagagaacagcgacacaagagtcttccagcttttaccaccttgtgaattctatgtatttattattccctttgaaatggaaggggacacaacagagatacccgggggtcttccatctgtatatcagaaagcactgggtcaaagagaacagaagatacagatctggcagaaaactgtgaaggaggctcatttgacaaaggatcaaaggaagcagttccaggtactggtagagaacaagttttatgaatggttgattaatacaggacatcgccaacagctggacagccttgtaccccctgcagcaggctccaaacaagcagctggataaggatcttacatgcagacactgggccctggaaatacaaggataaatggaggatggtgctcatcttgaaacttgaaactaaattgggaaggtgctattgctgcttaagagacattgggacttttctgtctttttttttttttttttttgaggcagagtcttgttctgtcgcccaggctggagtgcagtggcgcgatctcggctcactgcaagctctgcctcccgggttcacgccattctcctgcctcagcctcctgagtagctgggactacaggcgcccgccaccacgcccggccaattttttttgtatttttagtagagacggggtttcaccgtgttagtcaggatggtctcgatttcctgacctcgtgatccgcccatctcggcctcccaaagtgctgggattacaggcgtgagccaccgtgcccagccttctgttctatttaagaactttgatttccattccattttcatttattactgtttaggccgaattttcgctaaacttctgactttcatataaacatattgcttatagaacatcagaagactcgtctttgtgatgcccaaatgaaaaagttggtgaaggtagtaccattgtatgtatgttaatattaaagcaactgagtgtagatttgcaactatagtgtgtatcttcatttgtgtgatgaaagagttttattctttctagagttaaataagagttttatagttctttgtaactatttaaaaggaaattgctactccttttaaaaaataattggaaaggaagtatgatttgttggtatatagacatagaaatagttttatactatattttagtccttaaagtatggaacttaatgaaattgtttaaaaaaatctttatttttcacttcctgcttcaaattttcaataaacaaactct

SEQ ID NO: 2973 - DNA, 1294 bp, Homo sapiens
agtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggggaagtttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaactattgctgcagtcattcagatggaaatgaggaaagaataatattaataactgatttcaaaaaggacttgaagatgtgaatcatctattttgctg

SEQ ID NO: 2974 - DNA, 11198 bp, Homo sapiens
ggcaccgcccaccggcttgaatcccggcgcctcagaggactatgaggcgggcgccaactgcttgggccgcagggcgggaggcagcgcgggagtggggcgttgaggggccggcctagcttggggctctggccttgcgtcttccgaccgaatcaccgctcctgagcccggtgcggggctgccgctatcgcctggccgtgggtgccggagcggccgggttgcgactcagcgttcttgggtgggcgcgggcggcgtctccgcggcgggcatcccccgaggccgccctcgggccatgatcgactccgtgaagctgcgccgcgacagcgcggcggacttcttctcccactacgagtacctgtgcgcgctgcagaactcggtgccgctgcccgccgtgcgcgcctgtctccgggagggcgtgctggatttcaacgccgaccgcctccgcggggtggactgggcgcctctgctgagcaccctcaagatcaataaagacctgcccttggtctccatcaagagcttcttccagccctggctgggggacacaggttctgacatgaataaattttgcagaagtcgtgttcctgcgataagatacaaagatgtgaccttccagttgtgtaaagctcttaaaggctgtttaagtatatcaagtgtgctaaagaacctggagctaaatggactaattctgagagagagggatttaactattctagcaaagggattgaataaatcggcttctttggtgcacctgtctcttgcaaattgtccaattggagatggaggtttagaaattatttgtcaaggtataaagagctctatcactcttaagacagtcaacttcacaggatgtaatctgacatggcagggagcagatcacatggccaagatcttaaagtatcagaccatgagaaggcatgaagaaacctgggctgagagtcttcgctataggagacctgatcttgactgtatggctggcttaagacgtatcacactgaattgcaacacacttattggtgacctaggtgcatgtgcttttgcagactctctcagtgaggatttatggctgagagctcttgacctgcaacagtgcggcctcaccaatgaaggagcaaaggctttgctagaggcccttgaaaccaatacaactctggtcgttctggatataagaaaaaatccactcattgatcattctatgatgaaagcagttatcaaaaaagtcctccagaatggaaggagtgccaaatcagagtaccagtggataacttctccatcagtgaaggaaccatccaaaactgctaaacagaaaaggagaactataattctaggaagtggtcacaaaggaaaagctactattagaattggattggctacaaagaaacctgtaagtagtggcagaaaacactcccttggtaaagaatattatgcgcccgcacctcttccacctggtgtgtctggtttcttgccgtggcgtactgcagaacgtgcaaaaagacacaggggtttcccattaatcaaaacacgtgatatatgtaatcagttgcagcaaccaggttttcctgtgactgtgacagtagagagtccttcatcctctgaagttgaagaggttgatgattcttcagagagtgttcatgaagtgcctgagaaaactagtatagaacaagaagcattacaggaaaaactggaggagtgcctaaagcagttaaaggaagaaagagtgataaggcttaaggttgataaacgagtcagtgagctggaacatgaaaatgcccagttaagaaatataaatttctctttgtctgaagcccttcatgcacagtcattgacaaatatgatcctggatgatgaaggtgttttgggcagcattgagaattcttttcagaagtttcatgctttcttggatctccttaaagatgctgggcttgggcagcttgccacaatggctgggatagatcagtcagattttcaattactaggtcatccccagatgacttctactgttagtaatccacctaaagaagaaaagaaggcgcttgaagatgaaaaaccagaaccgaagcagaatgccctagggcaaatgcaaaatatccagtttcagaaaattacaggtgatgctagaattcctttgcctctcgactcctttcctgtcccagtttctactccagagggcttaggaacttccagcaacaacctaggagtcccagctactgagcagcggcaggagtcttttgaaggattcattgctagaatgtgttctccttcaccagatgcgacttctggaactggaagtcaaagaaaagaagaggagttgtccagaaatagcagatcttcttcagagaaaaagaccaaaacagaatcccattgaaatgactggagaaatattaaaataaaaataatagcagagttggaaaaccagaaatttgaacagtgaaatttctggaagataagaagcagatgatttaagtaccagttaattaaaggatggaacagctaagccattccactcatctttggagcatctgattctggagtttgccaccaggctaagaaagcagctatctgaagtgggagctctgacccaagaaatgctgggatcggagaataagggaattatccaaaatggctccgaagaggaactgaagttaagctgcccacatgatctctctaactatgatgacctgccacttccgtttataatcaccatataagtgcctgtaatcatttgtgttcattaaaagtgaaccagaattcccatttggatgaaaaaataacacttccaactttaatcttaggccctcatttataaatatggacaaccaagaatcatcaaatttgaagaaaaccagtaacataaaaggaggcatgaaattaaaattaacctgttcaagaagatagttactaggagaaacatgaaatttttaaattaatgaatcaaaatcttcagcaattcataaagatactgtgttcataaagaataggatgccatgaaaaaaatatttagagtttctggaaattaaaaatttgattatgaaactgaaacactcagaagatggactacacagcagaatggattcatttgaagcttaaattcatgaaatggaaggtattaattggtcttagacgtttcatcagcaacttaattacttagaaaaaatctttctcagagtaactaagcaaaatgaacaatgaacccattaacgtgtggttttgttttttgggttttttttttttgagtcaaggtctcactcatgtcacccaggctggggtgtagtgatgggatcacagcttattgtaaccatgaaccattgggcttaaattatcttcccacctcagcctcccaagtagctgcaatgtaccaccatgccgaagttttaaaaaattattgtagagttgggttctttctttcttttctttttttctttttttcttttttttttgagacggagtctcgctctattgcccaggctggagtgcagtggtacaatctcagctcactgcaacctcctcgatctcagctcactgcaaccgtgaagtgatcttcctgcctcagcccccctagtaactgggattacaggcacacaccaccatgcctggctaatttttgtatttttagtaaagacggggtttcaccatgttggccaggctggtctcgaactcctaacctcaggtgattcacccacctcggcctcccaaagtgctgggattacaggcatgagccactgcatccggccaagatgggttctttcttaggctggtcttgaactcctggcctcaaatgatcctcccaccttggcctcccaaagtgctgagactacagacctgagccactgtgcccagccccatgaaagatgtttagatcaaataaactgataaagatattgataaagatatgagacaaactacttcagctttgtgacctgcaaatccccttttataatcaccagaggtgcctgtagtcagaaaaagtctaaataaatactaatgacatatgaaaacaaagtccaaccaaagttctaggtttgaacatgaatggaggcatggcaggacacagaaagtgaaagcttgtcctagatattgtcttattcatgggaaggatacaggtagtgtttgattctaggtattgattgaaaaaatatattaaaatatatataaagttaagggtatgttagtaaggataggttaggtgatgttgcattaacagctcccaaattttaattactttcaacaacataggtttatttgtgcccatgcagtttgcctttggcagattggctagaggcccctattcaacatcaacctcaatctggaagcgaggctggtggaacgtcactatttggaacattgctggttgcagtgtccaaggaaagacagtatgatgcagcatatattgtgacttaaagcttctgtctagatgtgacatatgtcacttctgttcacatttctttggccaaagaaagtcacatggttatgcctgagttcagcagaccagggaagtgcagaattgccatttgccatgagaagagagggaagcaaatgtatgtcaacaactttaatagctacaaaactacctggaaagagggaatggaatttttaggtccaacaagacgggaaagaaaaagaaacaagctacatagaaataaaaaatccacaatatagcaagatcaagttttttactcataataaacatgaacaggttaaattctggaatccttaggcttgagtaaaaacatgaaatcccactgtgtgctatttgcaaaatctaaaacgctgtcatagattataaagagatgaacaaaaatataccaggcagatgctaaagagtaaatgtggctgtgttagctgcagactaaatagaacccaaggtgaaaattggtaaaggggacaaaagcttcttttggctgataagtacagtgttgcagaagattttttaaaaaaatatatctgcaatttaaaaacttgatgttaggccgggcgcagcggctcacgcctgtaatcctagcactttgggaggccgaggtgggtggatcacctgaggtcagaagttcaagaccagcctggccaacatggcaaaactccgtctctactaaaaatacaaaaaaaaaaaaaaaaaattagctgggtgtcatggcgcatgcctgtaatcccagctactcgggaggctgaggcaggagaatcgcttgaacctgggaggcggagtttgcagtgagctgagatggcaccgctgcactccagcctgggccatagaggagactccgtctcaaacaaacaaaaaccttcatcttaaaattatagggtaagaatttagaaatacaaggaaaaatggccagccagttataacaagaagctttaagacatctcttttcagaatcagtggatcgactgctgcacacacactagaatggctaacattttgaaatgctgataaatatgcagagcaactggagttcctcacagctggtaggaatgcaaaatgactcagtcactcaaaacagtttggcagattctttaaatgctaacatacacataccatatgaccaagcagtcccactcctgggtatttagagagatgaaaacttagttcacacaaaacctgtgcgtggatatttatagcagctccattcatagtgaccaagatgtcttccaacaggtgaatggatagcgatgtatccatatggtggcaaacatgccacaattcggatgaatctcaacatcatatgctgagtgaaaaagccagtctcggaaggctacattctgtatgattccatttatatggcattcttgaaaagacaaaactatagtgacagaacagattggagattgccaggtgttggggttgggaggagttgattacaaagaggctgtacaagggagtttgtttgtttgtttgttttggtgatgaacagttctgtatcctgattgcggtggtggtaacgtgagtctatacatatgttaaaatttatagaactgcatactctcaaaaaaattagttttactctataataatattagagcttaaaaaattcatccctcttgcccatcagtagatcaggatatgaaggataccattgaacataaatattttgtatccatgatgaatacaaagtatattctcctggaaaaccaatagaacattcatataaatgattcctatgaaggtaaaaaacttacaaaattcaaagatcatacagatcatgtgctctgtataatgtaataatagtaacaaaaggcctgtccacttggaaatttttaaatgatcttctaaataactcatttaaaggagaaatcaaaataaattgcaaattatttagaattaataaaaacttctctaaagctgaggaattctaccaaagaggtgttagaggaaattgtatagattttgatttactttccaggaagaaagaagacaaaagagatgaattaaacatttaaagctaagaaagagataaaccaaaagaaaggtgaggaattggtaaaagcagaaatgaataaaatagcaaattttgatcagtgaaacacaggtttttaaaaatgaaagataaacctttgtaaaatatgataaagaaaaaaaagcaagaagtaattaacaaaaattgccagcattaggaataattttagaaggatacctacaactagaagagatatttttaattatgagcacttttataatttactataaataattgtgtagtgttaaaccaataaatttgaaagactagatgaaatgtgactgtttaaaaatatggattgtaaaaattgataaaaaatagaaaatgtaaataaacgaaacatcttaggagaaattgaaaaaataggacaagaacttatttttaaaaagaggccaggtgcggtggcccatgcctgtaataccagtactttgggaggccgaggtgggcggatcacctgagatgaggagttcaagaccagcctggccaacatggtgaaaccccgtctctactaaaaatacaaaaattagccgggcttggtggcgggcacttgtaatcccaactactcaggagtctgaggcatgagtgtcgcttgaacctgggaggcagaggttgcagtgagctgaggtcacaccgttgcactctagcctgggagacaagagggaaactctgtctccaaaaaaaaaaaaaaaaaaatacagttagaaaaactttaaaggggccaggtgtggtggctcatgtctgtaatcccagcactttgggacaccaaagtgggaacattgctgagaccagcagtttgagaccagcctgggcaagacctcatctctacaaaaattaaaaaacaaaacaaaacaaaaaaacccaaaacttagccaggcatggtggtgcgtgcatgtagtcccagccactcaggaggctgaagtgggaggatcgcttgaggccgggattcgaggctgcagtgagctgtgatcatgccaccactgctctctagcctgggcaagagtgagactccgactcaagaagagaaaaagaaaaaccttccaggggcacatttatttgtaaaccattccagaggatagaaaagagatgtaaggctccctaattcattccatacggttagcgtaatccttatagcaaactgcacaaataaaacacaaggaaaactaaaccaaattcaattaatgtaggtgcaaaaaatccaaaataaaactagcagtttgaattcagcattgtagcaaaagatatatcattttcaaggaagatttgtaccaaaacatgcaagattgagtgaagagtaactcactgtagctcactaaattaacagattaaagaagtatagtcatcttcacaagctgaaagagtatgtgataaattcaacatcctctggtattcttaacaatctcgaaatagaaggaaacttccttagcttagcttcttggcttcattaaatatacctaacagaaatccacaggaaacaaacttggtgaaaagtttttgctaagataaaaacggtactaaaaagtacacattttgggaaatgagacaaggctctcgttatttgtaaatatggggtctttttttttttggacaaaaaaccccctgtgatgatctactggcatgctattacagctaataaagctgaataaggaggctgtgcacaacaccaacacaccggtatgaaaagtgtgtacaccagcaataaccaattagaaaatgtatgaggaaatagactctcatccacaatagctgcgagaagtaaatattatctagaaataagattaacaagagaaatgtaaggcctatataaataaaaggataaatctatgctagagggtataaaagaaacacaaaaatagaggtatgccatgtataagacccaacataataaatagttctaccaaattaatttataaattcaaagcaatttcatataaccacagtaaagctttttaaatggatgtaataacctgattataacattaatctgaaagtcatcaggcataaagcaattttgattacatctcaaaacaatccatggagttagggtaaatgtgctgttcacacaggaataatcacaggtatagaaccgagaacctaggaacagagcaatgtatatatatatgtatttaaaaaatggcatcacaagtcagtagagaagggtttgaactattcagtaaatgatgttgaggttatttactactttttcttatttcatatcatggatgaaaaaaatcaagatgaattaaacatggaaattaaaaataactagaagaaaatactggaaaaaaattgtaataaatgtgtaagaaaggcattcccaaccaagacacaaaacccagtagccatgaaaaaaaagatagatttgactacatttttaaaaagtaaaacctttcactttttacaaaactttgataaaattagatttcataaataaaggagtgggaaaatacatgtaatagaacagaagatttaagataatataaagagcacctacaaacaacaaaaattggacaaaggctataaaaatattttataaataagaaatacagactataaacataaactttcaacctcgtaagcaatcaggaaaattaaagttaaaatgagatactatttttcaatacattgaaatggcagattattaaagattggtgatagtgctggagataatgtgaggaaaggagtattctcagtcattgtagaaattgatacagcttttggatggacagtttgacagtgtgtatcaacatgtgaaatgtctccagcctttgatctaatgactaattttaggcatccagcctgaagaaatattcacacaagtgcccaaagagtcagatacaagactgtgtgaagtgttttttgagataataaaaaactagaaacagcataaatgtacagaaatgcagaaattgttgaattagtacataccaatttctgacatataacactctgcagcagataaagacaatagctctctagtgtggacatgaaaatatttctaagacattgacaggacgaagaagttgcacagtaaccacgcactcctgtttacatttgtatagttaaaacttgtttacctatacgtagcatatatgcgtgtgtgcaccctagaaaagagtctgtgataacacatatcaagctattgacagcggttttgtctgctgaaggaggaaaaaaggggggcttctcacattttactccatttaattctaggttgtttggtttaaaaaaaaagtttttatgtacaacagacaatttttaaaattccttttcatcatagaaaatgaaaatgtgtactctgttatcctttacgctctgtccatttttttcttcaaaaatgtgtctgacctattatcaatgtgaatgaaaatgagctttgctacataacctcttttcagagctttgtattcctgaagtgttggagtcgcctacatggcatagtcaaatgtttttaacttaaccacaacccacagtaaaaatgaagctttctgcaaagttaaaagtagtagtcctggccccaccttccttgtgtgcacgtataattaatggaaaattgcatcaaacaactctgattgtacttctagtgactaattcatgttctgttctattccttgcctttaaagaaaattatgttggcaactcacgaagtatgtttcacaatccactaatgggtaatgtcctactgtttggaaacactggctagagtgtttcaaacatctgctctgtttacccctgacaaaactgctactcgtggggcaatgcaagtctttcccacatttgttttattttatggctaaaagtcatttctgcatttgcaaattacttccaaagcctaccttccttgagctctttaactctctatagtcttctggtaattttctttagatttcccttttcagaacccttttgtgacactgaaaacctgagttttcaaactgatacatctacctgagaattttcacatataatttggtcaaaaagttaaaaaataagaagactttgccctgtgactgaggtgctcagaaggtatggctggctgctcacaaaggcacatagtgagtgataggggctgaaagggctcagagaatgcccgagttctcttagtacagtttgtacattttaaaccactgtgaactgaaaaaaaaaaaaaaggcaaccttggtagtttagaaatagataaggacccacttatagattaaataataattagcttgttccagagagaccagtgaagattagttggtttatttaatgtgttagaaagatggtcctcaaagtccttgaaatgtgaaggcggcttttatctccttaagaaaacaagaaaactccacaaaatcttgaaagctagataatcctagcttaaatgataaaatttgagtagagtttgaaaacactaaaatcagtttgccaaataaccagctctaatttctttataccaaagccaaacttcacctaaatcttacctaagaattgagttccttattgtaaccagataggagacacttttgtatattattccaaatattgcaaacctacaaggagtaaaaggtgttattattttaaagaagaaggaatgaggcctgagaggtattgattcacttggttgagggcttcaagtagcacaaggcaaaagcaggatttgttgacttccaaacctgttttcttccttcaccatgtggcctttgcatctttcccacacaaatattattccacaaatatttattgtcaccaactataataaaagaacagaactatgtatca

SEQ ID NO: 2975 - DNA, 940 bp, Homo sapiens
gggtggcgcccgcggcaggcggcggccatgaacttctccgaggtattcaagctctccagcttactctgcaagttctccccggacggcaagtacctggcttcctgtgtccagtaccggttagtggtccgggatgtgaacacccttcagatccttcagctgtacacgtgcctagaccagatccagcacatcgagtggtcggcagactcgctcttcatcctgtgcgccatgtacaagcgagggctggtgcaggtctggtctttagagcagcccgaatggcactgcaaaatagacgagggctcagccgggctggtggcctcgtgctggagcccggacgggcgccacattctcaacaccacggaattccatctgcggataaccgtctggtccttgtgcacaaaatccgtgtcttacatcaaatacccgaaagcttgtctgcagggaatcaccttcaccagggacggccgctacatggcgctggcagaacggcgcgactgcaaagattacgtgagcatcttcgtctgcagtgattggcagctcctgcggcattttgatacggacacccaggatctcacagggattgagtgggccccaaacggctgtgtgctggcagtgtgggacacctgcttggaggtgcgcatccttaatcacgtgacttggaaaatgatcacggagtttgggcatcctgcagccattaatgatcccaagatagtggtgtataaggaggccgagaagagcccacagctgggactgggctgcctctccttcccgccgccccgggccggggccggccctctcccgagctcagagagtaaatatgagatcgcctctgtcccagtctccttacagacactgaaacctgttaccgacagagcaaacccgaaaatcggcataggaatgctggcatttagtcctgacagctacttcctggcgacaaggaacg

SEQ ID NO: 2976 - DNA, 1224 bp, Homo sapiens
agtctatccccagtgtgagctagagagcggaccatgaaggaagtgggcagaccccgggaagttagaggacgcccggggaaaagcagaattcagaaggagctggcggacatcactttagaccctccacctaattgcagtgctggtcccaaaggcgataacatctatgaatggagatcaaccattctagggcctccaggatccgtgtatgagggtggtgtattctttctcgatatcacttttacaccagaatatcccttcaagcctccaaaggttacatttcggacaagaatctatcattgtaatattaacagtcaaggtgttatttgcttggacatattgaaagataattggagtccagcactaaccatttctaaagtcctcctttctatctgctcacttcttacagactgtaatcctgccgaccccttggtgggaagtattgccactcagtatatgaccaacagagcagaacatgacagaatggccagacagtggaccaagagatacgctacataaattggggtttcacaattcttacattatttgtctgtcacagaagagagctgcttatgattttgaaggggtcagggagggtgggagttggtaaagagtagggtatttctataacagatattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaa

SEQ ID NO: 2977 - DNA, 795 bp, Homo sapiens
agaggccaggtgcggtggctcgcgcttacattcctagcactttgggaggccaaggcgggcggatcacctgaggtcaggcgttggagaccagcctagccaacatgatgaaacctcgtctctactaaaaatacaaaaaattagctgggcgtggtggtgcgtgcttgtagtcccagacactccggaggtgaggcgggagaatcgcttgagcccgggaggtggaggttgcagtaagccaacaccgtgccactgcactacagcctgggcgacaggctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaag

SEQ ID NO: 2978 - DNA, 962 bp, Homo sapiens
ggcctcgaccctatgctttgattcgcgtggcgcaggcgcctactgccccgccggcggggcccgggcttcctgccgcgggatgttctcccgaaggagccacggggatgtgaagaagtccacccagaaggtgctggacccgaagaaggacgtgctgacccgcctgaagcacctgcgggcgctgctggaaaatactgcagtttctacctgaacgaattttctttcgatggcattaccagagtataggctcaactttaaagaagcttctacacactggaaattctattaagataagatgtgaaggaatcaggctgtttcttctgtggcttcaagcacttcagacaaactgtgcagaagagcaggttctgatttttgcttgcctggtgcctggtttcccagcagtcatgtcatccaggggcccttgcacactggagacactcatcaatcccagccctagtgtagctgatgtaaagatatatccagaagaaatcactccactcctaccagccatatcaggggagaagattgctgaggaccaaacctgcttttttcttcaaatactgttgaagtatatggttattcaggctgcgagcttggagtggaagaataaggagaatcaagatactggttttaaatttctttttacattgtttcgaaagtattatcttcctcatttatttccatcatttactaagttaacaaacatctacaaacctgtacttgacatcccccatttgagaccaaagcctgtgtacattactaccactcgagacaatgagaacatttacagtacaaagattccatatatggcagctcgtgttgtttttattaagtggattgtaaccttctttttggaaaaaaagtatctaactgcaacacaaaacactaaaaatggagttgatgtattgcctaaaatcatccaggtatgccatccatcatctttttatctgttaatgcttgtgtaa

SEQ ID NO: 2979 - DNA, 1947 bp, Homo sapiens
gagcgacgcgtacgtctacctgcctgccttacagggcacctaggagggaccccttcctggcccatccgcgccgcgcaggcgcacgcccacgcagcgcctagacgcccgagccgagcgtcccgtctcctagtaaccagccgctagcccccttttccacgactcatttcttaatctctgcctgaggctgccgcacctggatggaacgcgcatgcgcaaggctgtctctcgcagccccgccttccctcagcttgaaacacctgctgcttcgcggcggtggctttgtgccacttttcccagggcttgggcatcattctggacccatgttcggtgaaccggttactctcagagctgctttcgggcgcagctcctgctgcagccagggcccgttttaagagaggcttccaggtccagccctcccgctgcagcctgcagggagcgagccggcctgtcccgatgacatagacactaggtttttacagcaattctctgatgaccttgatatggtagaacgctgtgtatttcaagagtaagctctcgtttgaggagactaacaattcctgttttcgccagatttcttcttgaatggcaacctaaatgccagtccaaagaggcccccaatagacttgttcacccttcatgtcctcaactctggggaagttaagtaatcaagttgaagaaacacttccactacttaaaaagcctctaaagagagcaatcactacacttatggctgggattttgcgcttagtagttcaatggcccccaggcagactacagactgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataagaatcaagcccttgaagttgccacaaggacttccagcagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaagatgacggagtcttgctctgtcacccaggatggagtgtaatgccacggtttcagcttactgcaatctctctgcctcctggcttcaagcatttctcctgcctcagcctcccgagtagctgggaccacagaaaccacaacaaaggtgcttgcccatggctcctcgcttccctctgcctcatgactgatgccaattattccccttgtggccccctgtggtgtgacatgtactccctctccggggatccgaaatgaaaccaatttctacaacataggaatgatttcggcatgtctaggagagtcagagaaaagacgggagggaaatgggggagaaagaaaaacgtgagagaaccttctacttcctgaaaggcaccatgactctggaatgttacctgtaattaagaatgtcagaagaaccgagcctccattctaaagtttctgtggtgaagtcatctgtatttcctaggaaacttgaagaggaacaaactgaaacttgacaaaactcggaagagacttacaagaatcagaagtgcacacatggtgccatatttggaagtcatgaagaaaaactgaacagcattaccgaggaaaaacttcttactcctaaatatgcaacgctgtcagtaagaagcacattaaggctaagggttactaataatatttaaataaatgtggccattatgcttctagg

SEQ ID NO: 2980 - DNA, 1476 bp, Homo sapiens; identical to SEQ ID NO: 1945

SEQ ID NO: 2981 - DNA, 380 bp, Homo sapiens
accttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaaggacaagacaaagtgtggggacctggggaccctgcactcctccaaagtgagtgcctcctttcggctcagagaccttgctgctgaccaccacaggacacagaaatggcaaagaccagatgtggggacggcaggatggctgcctctcccctgatgaggttccttcagttctagcttaacatttgttcttccatgatcaccagaagactcctc

SEQ ID NO: 2982 - DNA, 2240 bp, Homo sapiens
cttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccagcccctgctggctctgctggcactcctccccttcctgctacttctgcatctgcccctgctcctcttgttcctgctactgtcccttcctccactgccccagacgctgctgctgggggtgcccagacccttgctgatggcttcacttctccaactccccctgttgtttcttccactccccctacaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggtataacagcataactgtgtagccaaaacaaaatcagattaagactgattcagaaaaatctgggatctttctcaggaatactgtatacccttgggatttctcctcctgcagaatctgtggcattggatgttcttcattgcctgtgctaaggggttaacctcatggcccagtgggtaccctagccccttcttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaac

SEQ ID NO: 2983 - DNA, 588 bp, Homo sapiens
agcgtggagccggtgccgagccggggcgaagctggatcccctagatagactgtcttcaagctcactgatattttcctctgcttgatccattgtgctgttgagagcctctagtaaatttttcagatgctgccatgaaagcaggcccacctttccttactggagaatattttgtgaatttgatttagaaaactgacagacttcaaggatgcagctgctactaccggaggtgtgtggcaccttacctcagcaaggccatgagaccgtgtggccatgatgtgggcccctcatggcctcagcaggaacacagcactatagtattggcctccgccagaaaaacagcttcaagcagagtggtccctcaggcacagtacctgccacgccacctgagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcag

SEQ ID NO: 2984 - DNA, 1398 bp, Homo sapiens
gacacaggaaactcccctgaaacctgtttctcagcttcccggcccagctggggcacccactggaaggagaggccaggcggaagaccctggctccgtcatggcctctgccctgaggccaccccgtgtccccaagcctaagggtgtcctgccttcacactactatgagagctttctagagaagaaggggccctgtgaccgggattacaagaagttctgggcaggcctgcagggtctcaccatttatttctacaatagcaatcgggacttccagcacgtggagaagctcaacttgggagcatttgagaaactcacagatgagattccctggggaagctcacgtgaccctggcacccacttcagcctgattctccgggatcaggagatcaagttcaaggtagagaccttggagtgtcgggaaatgtggaaaggcttcatcttaacggtggtggagctccgtgtcccgaccgacttgaccctgcttcctgggcacctatacatgatgtctgaagtcttggccaaagaggaggcgcgccgtgcactggagacaccctcgtgcttcctgaaggtgagccggctggaggcacaactgctcctggagcgctaccccgagtgcgggaacctgctgctgcggcccagcggggacggcgccgacggcgtgtcggtcaccacgcggcagatgcacaacgggacgcacgtggtccggcattacaaggtgaagcgggagggccccaagtacgtgatcgatgtggaacagccgttctcttgcacctccctggacgccgtggtcaactatttcgtgtcgcataccaaaaaggcgctggtgccattcctgttagacgaggactacgagaaggtgctaggctacgtggaagccgataaggagaatggcgagaatgtgtgggtggcgccctccgctccgggcccaggtcctgcaccctgcacaggtggccccaagccgctgtcacctgcgtctagccaggacaagctgcccccactgcccccactaccgaaccaggaagagaactacgtgacccccattggagatggcccagctgttgactatgagaaccaagatgtggcttcctctagttggccagtcatcctgaagccaaagaagttgccaaagcctcctgccaagcttccaaagccacccgttggacccaagccagagcccaaagtctttaatggtggcttgggcaggaagctgccagtcagttcagcccagcctctcttccccacagccgggctggcagacatgacggcagagctacagaagaagctggagaagaggcgggcactggagcactgattcggacacaccagggaccagcgggctagtcccagggcatggcccagcggccagattctttttcccaggattaaaactctgaccccagg

SEQ ID NO: 2985 - DNA, 1678 bp, Homo sapiens
gcggcgagccgcgagccaggcagtccggggcatccagactgcaggccgcgcccaggccgcgcccaggctgcgccgcccgcctgcctcccgcgctgccgcgtcgccagtgctagcgctcctctccagcatgctgcggcggggcagccaggcgctccggcgcttctccactggccgggtttatttcaaaaacaagctgaagttggcactaattggccagagcctctttggacaagaagtctatagccacctccgcaaagagggccaccgagtagtaggggtgttcacagttccagacaaggatggaaaagctgaccctctggctttggctgcagagaaagatgggacccctgtgttcaagcttcctaaatggagggtcaagggcaagaccatcaaagaagtggcagaagcctacagatccgtgggtgcagagctaaatgtgctccctttctgcactcagttcattcccatggatataattgatagtccaaagcacggctctatcatttatcacccatccatcctgcccaggcacagaggagcctctgctatcaattggactctaattatgggagataagaaagctgggttttctgttttctgggctgatgatggcttggatacaggacccatccttcttcagagatcatgtgatgttgaacccaatgatacagtggatgcactttataatcggtttctttttcctgaaggaatcaaggccatggtagaagctgtccaactcatagctgatggaaaagctcctcgtataccccagccagaagaaggggcaacatatgaaggtatccagaaaaaggaaaatgctgagatttcttgggaccagtctgccgaagttttacataactggattcgaggtcatgataaagtccctggagcttggacagagataaatggacagatggtcactttctatggctcgacattactgaatagctctgtgcctcctggagaaccactggaaattaaaggtgccaagaagcctggtctcgttaccaaaaatggacttgttctttttggtaacgatggaaaagcactgacggtgagaaatctgcagtttgaagatggaaaaatgatccctgcctctcagtacttttcaacgggtgagacgtcagtggtagaactgacagctgaagaggtgaaagtggcagagaccatcaaggtcatctgggctggaattttaagcaatgtccccattattgaagactcaacagacttctttaaatctggagcaagctcaatggatgttgccaggctggttgaagagatcagacagaaatgtggtgggcttcagttgcagaatgaagatgtctatatggccaccaagtttgaaggctttatccaaaaggtcgtgaggaaactgagaggagaagatcaagaggtggagctggttgtagattatatttcaaaggaggtcaatgaaatcatggtaaaaatgccataccagtgtttcataaatggacagttcacagatgcagacgatggaaagacttacgacactatcaacccaacagatggatctacaatatgcaaagtatcctacgcttctttggcggatgttgataaagcagtagcagcagcaaaagatgcttttgaaaacggtgaatggggaagaatgaatgcaagagaaagaggaagattgatgtatagcatgagaatgaactaa

SEQ ID NO: 2986 - DNA, 4666 bp, Homo sapiens
tggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggatttccaatttccaagcctgatgggatctcccagctggaacaggatctacaggtctttgatctggaaactaagactagagaagtcttaagagatgactgctcagatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccacctgtcctcccaaagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacacctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcaggagaactgcttgaacctgggaggcggaggttgcagtgagccgagattgcaccactgcactccagcctgggcgacagagcaggactctctctcaaaaaaacacaaaaaaacaaaaacaaaaaaccatacacacacacacacacacacaaatcagcatcataagggaatgtagccttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccattaccacatttttgtattttaatagtctacaggctatataaaagaacatggctttttgactgataaaagtgattacagatgttggctcaagttcagggccaccatcatatacctaacaagagttcatgattctttaggtaatgtcaaaacattttgtatttttccatcttaagctttataacattttgtgagtaagacaaatgttatttaaaattcttgttgtcagtccagcaattgaggctttcatagttcagtgttataatattcagtagggaccctcaacaaatatataaaaatatgttgctcactctataatcctcctatggctaacctctaggatagttctgccactatattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactgaaacaggattatgtaatccctaaaaagcagaatatgtaaaaatcacatgtatgcgtttggtttaggaatgtgcttttgtacttccacttgaataaaggtgtgtttggtattctg

SEQ ID NO: 2987 - DNA, 628 bp, Homo sapiens
gttctgatttttgcttgcctggtgcctggtttcccagcagtcatgtcatccaggggcccttgcacactggagacactcatcaatcccagccctagtgtagctgatgtaaagatatatccagaagaaatcactccactcctaccagccatatcaggggagaagattgctgaggaccaaacctgcttttttcttcaaatactgttgaagtatatggttattcaggctgcgagcttggagtggaagaataaggagaatcaagatactggttttaaatttctttttacattgtttcgaaagtattatcttcctcatttatttccatcatttactaagttaacaaacatctacaaacctgtacttgacatcccccatttgagaccaaagcctgtgtacattactaccactcgagacaatgagaacatttacagtacaaagattccatatatggcagctcgtgttgtttttattaagtggattgtaaccttctttttggaaaaaaagtatctaactgcaacacaaaacactaaaaatggagttgatgtattgcctaaaatcatccaggtatgccatccatcatctttttatctgttaatgcttgtgtaataaaatacactggaacatagccaaa

SEQ ID NO: 2988 - DNA, 536 bp, Homo sapiens
aacattaaacctggggaaggcctgggcatgtacatcaaatcaacctatgatgggttacacgtgattactggaaccacagaaaatgtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagacctcacctccacccgcgacaacccagtcccctgaaagcactatggatacctcactgaagaaggagaagtcagccatcctggatctttatattcctcctccgcctgctgttccctactctccccgggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccac

SEQ ID NO: 2989 - DNA, 3185 bp, Homo sapiens
gcttcagtagcgagaggggctgagaaagtggtgacaccgccggggtgcggagggagtccctgaaacttctcccaacagccccagggccaatcttccctcagcccactcccctcttcgccagctcccaggtccccactcctgtaccgggggtggggtggggagccaggcccgtctcccgctgggacacacacaggggccgggagcggggacgggacccccgaggcgggggggacgaaccgacagacagacggctgggcgcccgccccagcgggcaggcaggcaggaggaggcggaggcgggggtacgacggggagcactgggtctggggagtttcctctcaactatcgggggagaaactccccgcagccggaggaaagacccagacagtgttttcctcccgggggccgtgctcccccgccccgcgtagcggcggtcgccgccaccggcgcctccacctctaccatctcctctttctccaccacctcgggccccggtgtccccggccagcactatgcccatcttactgttcctgatagacacgtctgcctctatgaaccagcgcagccatctgggcaccacctacctggacacggccaaaggcgcggtagagaccttcatgaagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgagcttcatttacctcttaattctcctttgcctggaagtgaattgaccaaggaaccttttcgttgggatcagagactctttgcattagtgttgcggttgcctggcaccatgtcagtagaatcagaacagttgacaggtgtgcctttagatgactctgcaatcacaccaatgtgtgaagtgacaggcggccgttcatattctgtgtgttctccaagaatgcttaatcagtgtctggagtccttggtgcagaaagtacaaagtggggtggtaataaactttgaaaaagcaggaccagatccttcccctgtagaagatgggcagccagatatatcaaggccttttggatctcagccttggcatagctgtcacaaactcatatatgtcagaccaaatcctaaaactggggttcctataggtcattggcctgttccagagtctttttggccagatcaaaattcgccaacactaccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtgtacgtgagcaatagtgcaaaatacagtgaacttggtcatccttttggttacttgaaagccagtacagcactgaactgtgtcaacttatttgtgatgccttacaattatccagtccttcttcccctcttagcccttgaagaaagctgttaggatgatgggagcacctaacctaatagcagacagtatggaatatggacttagttacagtgtcatttcatacctcaaaaaactgagtcaacaggccaaaatagaatctgatcgagtcattggatctgtaggcaaaaaagtagtacaggagactggaataaaagtccggagccgatcacatggtttatcaatggcatataggaaagattttcaacaactcctccagggaatttcagaggatgtccctcacagactgctagaccttaatatgaaggaatacactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctccagccagtttactggaacggccaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagaggtcaatactgaactaaaagcacaaataatgaaagagatccgaaagccaggaagaaaatatgaaagaatcttcactttactgaagcatgtgcaaggcagtttacaaacaagactaatatttttacaaaatgtcattaaagaagcatcaaggtttaaaaaacgaatgctaatagaacaactggagaacttcttggatgaaattcatcgaagagccaatcagatcaaccatattaatagcaattaaaagaaaatagaatgtggccacttatttcactatcttcttcaaatacaaagtaaatacaagactgttgtgatcttgcattcattttctgacatgcattgttggcta

SEQ ID NO: 2990 - DNA, 1509 bp, Homo sapiens
ctggactgtgggccacggctgcctgtagaagtggggccatctctgtcctcccccagctcgggctgcggggaggggagcatcagcgtgggggagaacgtgtcagacgtggctcccacccaaccatggtggcccaacaccccgggagacagtgtctctgaagaactaggccctgggaggagcggggacactgaggacctctctccaaattggcctctcaactcacaggaagacacagctgcccagagcagcccaggccgtggtgaggaggcggaggcatcggcggcggaggctcagggtggggagcaggcctacctggcaggcctggcagggcagtaccacttggagcggtacccggacagttacgagtccatgtccgagccgcccattgctcatcttttgcgccccgtgcttccccgggccttcgccttccccgtggacccccaggtccagtctgccgctgatgagactgctgtgcagctgagcgagttgctgacgctgcccgtgctcatgaagcgctccatcacggcaccgctggccgcccacatctccttggtgaacaaggccgctgtcgactacttcttcgtggagctgcacctggaggcgcactatgaggcactgcggcacttcctgctgatggaggacggcgagttcgcccagtccctcagcgacctgctctttgagaagcttggagctgggcaaacgcccggagagctgctcaacccgctggtgctgaactctgtgctgagcaaggccctgcagtgcagcctgcatggggacaccccgcacgcctccaacctctccctcgctctcaagtacctgcccgaggtgtttgcccccaacgccccggatgtgctgagctgcctggagctcaggtacaaggtggactggcctctcaacattgtcatcaccgagggctgcgtgagcaagtacagcggcgtcttctccttcctgctgcagctgaagctcatgatgtgggcgctcaaggacgtctgcttccacctcaagcgcacagttccgtcagctgcagctgttcaagcacgagatgcagcatttcgtgaaggtcatccagggctacatcgccaaccagatcctgcacgtcacctggtgcgagttcagggccaggttggccaccgtgggcgacctggaggagatccagcgtgcgcacgcagagtacctgcacaaggccgtcttcaggcggcgcccgtcatgaacgtcatccacagcatcttcagcctcgtgctcaagttccgcagccagctcatctcccaggcctgggggccccctgggggcccgcggggtgcagagcaccccaactttgcactcatgcagcagtcctacaacaccttcaagtactactcccactttctcttcaaagtggtgaccaagctggtgaaccgcggctaccagccccacctggaggactttctgctgcgcatcaacttcaacaactactaccaggacgcctgaggctgctctgcgggggacgtgcacaataaaggtgttctcgga

SEQ ID NO: 2991 - DNA, 4403 bp, Homo sapiens
gggcccgtcctcgaggcgcgcggcgcggggcgcgggcgccggggcctgaggcggcgggcgacgcccgggggcctgacggccggccccgcgccatggtgtgagcgccgccgcccgtgcacgctccgtccgccctccgcgcggcccggccggcagagagccccgagcggcccgagagcgcagccgagcccgccgccgccgcccgcggccccgcgaggagagtaccgggccggctcggctgccgcgcgaggagcgcggtcggcggcctggtctgcggctgagatacacagagcgacagagacatttattgttatttgttttttggtggcaaaaagggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagagtacagttgaccaaaagcgtgccagccatcatgagagcaatggctttgccggtcgcattcacctcttgccagatctcttacagcaaagccattcctcctccacttcctccacctcctcctccccatcctccagccagccgacacccaccatgtccccacagacaccccaggacaagctcactgctaatgagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattcta

SEQ ID NO: 2992 - DNA, 456 bp, Homo sapiens
gcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaagacggagtctcgttctgtcaccaggctggagtgcaggcgcgtgatctaggctcactgcaagctctgcctcccaggttgaagtgattctcctgtgaaagggaattatttttgatgagtcattaaagtatatccattcccagaa

SEQ ID NO: 2993 - DNA, 2088 bp, Homo sapiens
ggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggacgatccgtaaggctcagaaccttctgaaacagtattcccagcatggtctagatgggaaaaaggggggctctaacctcattcctctggaagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaaggtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttg

SEQ ID NO: 2994 - DNA, 2252 bp, Homo sapiens
ttcgcggtgccaccgccccgcccacgcctcctcgccggcctccgagtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagcattgtc

SEQ ID NO: 2995 - DNA, 2248 bp, Homo sapiens
gtctttccctttgacaagtcgctgctgctgcagcaaaaataaaggacgcgaccgccgcagcctctgcggagccgggctcgggtcgccggagccgcgccccaccccgccagctccagagccacgactaatggctgaaggataaatcaacatggcaactatgattccaccagtgaagctgaaatggcttgaacacttgaacagctcctggattacagaggacagtgaatctattgctacaagagagggagttgctgttctgtattctaaactggttagcaataaggaagtagtacctttgccccaacaagttttatgcctcaaaggaccacagttgccagactttgaacgtgagtctctttcaagtgatgagcaggaccactatttggatgcccttcttagcagccagctagcattggcaaagatggtatgttcagattccccatttgccggggcacttagaaaacgactgcttgtactccagcgtgtcttttatgcactttctaataaataccatgacaaaggcaaggtgaagcagcagcagcattctccggagagcagttctggttcagcagatgtccattctgttagtgaacgcccccggtcaagcactgatgcacttatagaaatgggtgttcgaactggtctaagtttattatttgcgcttctaagacaaagttggatgatgcctgtgtcaggacctggtctcagtctttgcaacgatgtcattcatactgcaattgaagttgtgagctctttgccaccattatcattagcaaatgaaagcaagattcctcctatgggcttggactgcttatcgcaagtaacaacatttcttaaaggagtcactattcctaattctggggcagacactttaggtcgtagattagcttctgagttgctgcttggtttggcagctcaacgaggctcattgcgatatcttcttgaatggatagaaatggctttgggggcttcggcagttgtacacaccatggagaaaggcaaactactctcaagccaggaaggaatgatcagctttgactgctttatgaccatattaatgcagatgaggcgttctttgatatcagaaaaccaggactctgcagatgttgatcctcaggagcattcatttactcgaactattgatgaagaagctgaaatggaagaacaggctgagagagaccgggaagaggggcatccggagccagaggatgaagaggaggaacgggaacatgaagtgatgacagctggcaaaatctttcagtgtttcctctcagcccgtgaagtagctcgtagccgagaccgagatagaatgaacagtggggcagggtctggggctcgagctgatgatccacctcctcagtctcagcaagagcgaagggtcagcacagaccttcctgagggtcaggatgtgtacactgctgcatgcaactccgtgatccatcggtgtgccctgttaatattaggagtaagtcctgtgatagatgagcttcagaagcgaagagaagaaggacagttgcagcaaccttcaacaagtgcctctgaagggggtggacttatgaccaggagtgaaagtcttactgcagagagccggctagtccacacaagcccaaattatagactgatcaaatcgaggagtgaatctgatttgtctcagcctgaatcagatgaagagggttacgcactgagtggcagacgaaatgttgatttggatttggcagcatctcacagaaagagaggtcctatgcacagtcaattggaatccctgagtgactcttgggctcgcctgaaacatagcagagactggttatgcaactcctcctattcctttgagtcagattttgatcttaccaagtctttgggagttcacactttgattgaaaatgttgtaagctttgtgagtggagatgtggggaatgccccaggttttaaagagccagaggaaagtatgtctacaagtccccaggcctccatcattgcaatggaacagcagcagttaagggcagaacttcgtttagaggcacttcatcagatcctcgttctattgtctgggatggaagaaaaaggtagcatctcactggcaggaagcagattgagttcaggcttccagtcctccacactactcacgtctgtgaggctgcagttcctagcagggtgttttggtttaggcactgttggacacacaggaggcaagggagagagtggccgattgcatcactatcaggatgggatcagagcagcccgaggttat

SEQ ID NO: 2996 - DNA, 1034 bp, Homo sapiens
acaattgcattcccgggctggatgccggttgttaagcgcgctgttgctttgtaaaaatgcgtgtgttctggtgttttggctggggcagggaggggacaccccacgaggtctggggctgttgcccttgtgtcatccccccgccttttaactgcaaaggtcaccatggctgaccgggctgctgccgaaagggcctgcaaggatcccaatcccatcattgatggcagaaaggccaacgtgaacctggcatacttaggagcaaaaccaaggatcatgcaaccaggttttgcctttggtgttcaacaacttcatccagcccttatacaaagacctttcgggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaaagttgaattgttttctctttccctcccaattttccaatttttagtagctaataagagagttaacattgacttaacagctttaaaaaaaaaaacagccatgctattgtgaagcagagttattattttttttatactccaggtagtgttctagatgagaaagaggtaagaatgaggggaatgggcacaattttggaaatcaatcccaaagagcctgagtaaatgaaaggccactacgaaatgacgccaggagtaacaacggaacttcacttttgtaacgggatttttatttttgctctttttatagtatcagggaagcaa

SEQ ID NO: 2997 - DNA, 2014 bp, Homo sapiens
agagcgtcatgggacatgtagttccggcatcgcgcctggtggcggagttctgccgagtggggcgccgcggccgctattgtcccgccccctgctccgcaagattcgagcctgagcggcctgggcgtctcgagaggtgagagagttggcggcgaggtctcggcggctaagcgagcgtcggcgactgtctctccgcgagaggaggcaagttggggtccaggctccaaagccggtggccgcgtaccgcggtggagccgctgtctttgaggtctgaggagagaacagacagagtctagctctttcacccaggctggagtgaagtggtgcaatctcagctcagtgcaacctccgccccctgggttcaagtgattctcctgcctcagcctccccagtagctgggattacagtgatatcctgagagaagatgggaaagggctgcaaggttgtggtttgtggattgttatctgtggggaaaactgcaattttggagcagctcctttatggaaatcatactattggaatggaagattgcgaaacaatggaagatgtatacatggcttcagtagaaacagaccgaggagtaaaagaacagttacatctttatgacaccagaggtctacaggaaggcgtggagctgccaaagcattatttttcatttgctgatggcttcgttcttgtgtacagtgtgaataaccttgaatcctttcaaagagtggagcttctgaagaaagaaatcgataagttcaaagacaaaaaagaggtagcaattgtggtattaggaaacaaaatcgacctttctgagcagagacaagtggacgctgaagtggcacagcagtgggcaaaaagtgagaaagtaagactgtgggaggtgactgttacagatcggaaaactctgattgaaccattcactttattagccagtaaactttctcaaccccagagcaaatcaagctttcctttgcctgggaggaaaaacaaagggaactctaattctgagaactaaaaatcagtaatttccacaattgtatgttgaatagtgattgcctttaagtgtctgtgaacatggagtaatattactatttaaaataggccatttgtatctacctttggtccttaggaaaattcctaaggaagtcaattaatgcactttagatgttaaaagtatttgggctaaggttattattgcctgatatgaaataatatattcttattctcattgtttgaaacctgtctttgaaattagcacctttgttatttatgttgtacttgtgaaaacagtaaaatagtttggatagttatgcaaatgcacctatgtgtaacttccccccaaccccaagctgtttcggaagatatcataatcattctgtgtaacattatgcaaacttctaagcccaaacatgactttgtttttaaaaagttcattaatctaatgtctaggattataaaacatttttttgtgtctaaattggacccaaaacattgaacagtttggggtagtaagctaaatttcatcttgtggagattttgctaaacagactaagacccatgatttagctttgctcaaattagaatgtttagcatgagttgaggtaccaggtagtgttaagtaggttcatcacgctctaaggccgttttttccttagccagacccctgttgatagaccagatacttgagggcaaactgtttgctcctcctcttgaaaatgattaggcacttaaggacagtaaagctgtattttctggaaggaagactgtatcttctggaatagttttctagaaaactagtcatatacaataaaagtatcaaaaatattgggctctaatttgatctgacttagatgtctgagtttgtgttgtttctctaaagattttggcaagactcaagcaatgtggctgactgtaactttattaatttaaaaggtaggaagtaagctacttagtggtttcacctgtgaaataactattttgactgaaatgtaaaataagctattcaacaaagaacatattaaaacatcaa

SEQ ID NO: 2998 - DNA, 2080 bp, Homo sapiens
atgaacagaagccaaccaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagt

SEQ ID NO: 2999 - DNA, 3318 bp, Homo sapiens; identical to SEQ ID NO: 2439

SEQ ID NO: 3000 - DNA, 804 bp, Homo sapiens
gaggcggctactggctcaagaggacgacagaagccagtctctgatgcccaccgcattctccagcttcaggcctcaagccctgtagccgagaaggcgaggcctaatgttacaccaccggccaaggaggcgggtttggtgcggccactccaaggccaaagcgagaaaatcttactgcgcacgcgcaatagacagccgatggagccaccgatggagccgtccggaggggagcaagagcccggagccgtcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgggtccgcagatcccgcgggccgcattggcccggctgctgcgggatgccgaggggctgcaggagctggcactggcgccgtgtcacgaatggctgtcagacgaggacctggtgccggtgctggcgcggaatccgcagctgcggagtgtggcgttgggcggctgcgggcaactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagaggcgcggcgctggtctccgcagcctctctctggccgtcaac

SEQ ID NO: 3001 - DNA, 2441 bp, Homo sapiens
aactttgcctctcctttacgccaaatacgtgtccttatatctgaatctacaccactattatagattcaccttctttgagaagtccctatttgaagagaggaaaattcaggctacttgtaaccctcttattctttttagacggagttttccctcttgttgcccaggctagagtgcaatggcgcgatctcggctcaccgcaacctccgcctcccgggttcaagcgactctcctgcctcagcctcccgagtagctggaattacaggcatgcgccaccactcccggctaattttgtatttttagtagagacggggtttctccatattggtcaggctggtctcaaacccccggcctcagcctcaggtgatccgcccgcctcggcctcccaaactggtggggttacaggtgtgagccacggaacgcggctcctcttccttctggatatggctgtctcagatggccagaggcctcggaaaggcttccggtttcccggcaggcccgagtggggctgaacttccggcctcaggacgcaggcgcgggccgctcatttcgctctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagcc

SEQ ID NO: 3002 - DNA, 1638 bp, Homo sapiens
gtttgtctgccggactgacgggcggccgggcggtgcgcggcggcggtggcggcggggaagatggcggcgtcctccctggaacagaagctgtcccgcctggaagcaaagctgaagcaggagaaccgggaggcccggcggaggatcgacctcaacctggatatcagcccccagcggcccaggcccattattgtgatcactctaagccctgctcctgccccgtcccaacgagcagccctgcagctcccgctggccaacgatgggggcagccgctcgccatcctcagagagctccccgcagcaccccacgccccccgcccggccccgccacatgctggggctcccgtcaaccctgttcacaccccgcagcatggagagcattgagattgaccagaagctgcaggagatcatgaagcagacgggctacctgaccatcgggggccagcgctaccaggcagaaatcaacgacctggagaacttgggcgagatgggcagcggcacctgcggccaggtgtggaagatgcgcttccggaagaccggccacgtcattgccgttaagcaaatgcggcgctccgggaacaaggaggagaacaagcgcatcctcatggacctggatgtggtgctgaagagccacgactgcccctacatcgtgcagtgctttgggacgttcatcaccaacacggacgtcttcatcgccatggagctcatgggcacctgcgctgagaagctcaagaagcggatgcagggccccatccccgagcgcattctgggcaagatgacagtggcgattgtgaaggcgctgtactacctgaaggagaagcacggtgtcatccaccgcgacgtcaagccctccaacatcctgctggacgagcggggccagatcaagctctgcgacttcggcatcagcggccgcctggtggactccaaagccaagacgcggagcgccggctgtgccgcctacatggcacccgagcgcattgaccccccagaccccaccaagccggactatgacatccgggccgacgtatggagcctgggcatctcgttggtggagctggcaacaggacagtttccctacaagaactgcaagacggactttgaggtcctcaccaaagtcctacaggaagagcccccgcttctgcccggacacatgggcttctcgggggacttccagtccttcgtcaaagactgccttactaaagatcacaggaagagaccaaagtataataagctacttgaacacagcttcatcaagcgctacgagacgctggaggtggacgtggcgtcctggttcaaggatgtcatggcgaagactgagtcaccgcggactagcggcgtcctgagccagccccacctgcccttcttcaggtagctgcttggcggcggccagccccacagggggccaggggcatggccacaggcccccctccccacttggccacccagctgcctgccccttggcccctttgtcaggggccaggggtctgccgggtgggggtgccaacaggcctggccctttcctcccctgcatccagccatgggggcctctgcgattgccggaaggttgcatggctggtcccagggccagcacaggcccgaggccgggctgcctggttttatttttatttaactttattttctg

SEQ ID NO: 3003 - DNA, 3006 bp, Homo sapiens
atggcttccagtccgctgccagggcccaacgacatcctgctggcgtcgccgtcgagcgccttccagcccgacacgctgagccagccgcggccagggcacgccaacctcaaacccaaccaggtgggccaggtgatcctctacggcattcccatcgtgtcgttggtgatcgacgggcaagagcgcctgtgcctggcgcagatctccaacactctgctcaagaacttcagctacaacgagatccacaaccgtcgcgtggcactgggcatcacgtgtgtgcagtgcacgccggtgcaactggagatcctgcggcgtgccggggccatgcccatctcatcgcgccgctgcggcatgatcaccaaacgcgaggccgagcgtctgtgcaagtcgttcctgggcgaaaacaggccgcccaagctgccagacaatttcgccttcgacgtgtcacacgagtgcgcctggggctgccgcggcagcttcattcccgcgcgctacaacagctcgcgcgccaagtgcatcaaatgcagctactgcaacatgtacttctcgcccaacaagttcattttccactcccaccgcacgcccgacgccaagtacactcagccagacgcagccaacttcaactcgtggcgccgtcatctcaagctcaccgacaagagtccccaggacgagctggtcttcgcctgggaggacgtcaaggccatgttcaacggcggcagccgcaagcgcgcactgccccagccgggcgcgcaccccgcctgccacccgctcagctctgtgaaggcggccgccgtggccgccgcggccgcggtggccggaggcgggggtctgctgggcccccacctgctgggtgcgcccccgccgccgccgccgccaccgccgcccttggcagagctggctggtgccccgcacgcccatcacaagcggccgcgcttcgacgacgacgacgactccttgcaggaggccgccgtagtggccgccgccagcctctcggccgcagccgccagcctctctgtggctgctgcttcgggcggcgcggggactggtgggggcggcgctgggggtggctgtgtggccggcgtgggcgtgggcgcgggcgcgggggcgggtgccggggcaggggccaaaggcccgcgcagctacccagtcatcccggtgcccagcaagggctcgttcgggggcgtcctgcagaagttcccgggctgcggcgggctcttcccgcacccctacaccttccctgccgcggccgccgccttcagcttgtgccataagaaagaggatgcgggtgccgccgctgaggccctggggggcgcgggcgcaggcggcgcgggcgcggcgcccaaggccggcttgtccggcctcttctggcccgcgggccgcaaggacgccttctatccgcccttctgcatgttctggccgccgcggacccctggcgggctcccggtgcccacctacctgcagcccccgcctcagccgccctcggcgctaggctgcgcgctaggcgaaagcccggccctgctgcgccaggccttcctggacctggctgagccaggcggtgctgctgggagcgccgaggccgcgcccccgccggggcagcccccgcaggtagtggccaacggcccgggctccggcccacctcctcctgccgggggcgccggctctcgcgacgcgctcttcgagtcgcccccgggcggcagcggcggggactgcagcgcgggctccacgccgcccgcggactctgtggcagctgccggggcaggggccgcggccgccgggtctggccccgcgggctcccgggttccggcgccccaccatccgcaccttctggaggggcgcaaagcgggcggtggcagctaccaccattccagcgccttccggccagtgggcggcaaggacgacgcggagagcctggccaagctgcacggggcgtcggcgggcgcgccccactcggcccagacgcatccccaccaccatcaccaccctcaccaccaccaccaccaccaccaccccccgcagccgccgtcgccgcttctgctgctgcccccgcagcccgacgagccgggttccgagcgccaccacccggccccgccgccgccgccgccgccgcccccgccgccccctctggcccagcacccgcaccaccgaggccttctgtctcccgggggaaccagctgctgctaccccagcgaggacagctccgaggacgaggacgacgaggaagaagagcaggaggtggacgtggagggccacaagccccccgagggcgaggaagaggaggaaggtcgagaccctgacgacgacgaggaagaggacgaggagacggaggtcctactcggcgaccccttagtcgggggcggccggttcctccagggccgagggccgtcggagaaggggagcagccgggaccgcgcgccggccgtcgcgggcgcgttcccgctcggcctgaactcctccaggctgctgcaggaagacgggaaactcggggaccccggctcggacctgcccccgcccccgccgccgcccctggccccccagaaggcgagtggcggcggcagcagcagcccgggcagcccagttcaccatccatcactggaggagcagccctcctacaaagatagtcagaaaactaaggaaaataaccaagtaattgtatctacaaaggatgacaacagcttttcagataagaacaaggagcatagctttttcatcacagactctgatgcttctggaggagatttttggagagaaagatcaggtgaacatacacaagaaaccaactcacctcattcactgaaaaaggatgtagaaaatatggggaaagaagaacttcagaaggttttatttgaacaaatagatttacggagacgactggaacaagaattccaggtgttaaaaggaaacacatctttcccagtattcaataattttcaggatcagatgaaaagggagctagcctaccgagaagaaatggtgcaacagttacaaattgtaagctgcatttctacttaa

SEQ ID NO: 3004 - DNA, 566 bp, Homo sapiens
atgcgcagcggctcgctcggaagctgcgacgccgagtttcactctggctgccttctcctgagagtcggagccacagccagagccctgcccaggccgagccggagctgcagcccgagcgcggtggtgccctcagccccgtcctcttgtcctcctcagcctcggagctggtgtcttcatccagaagggacagtttgtgccagctctccagagagaaaagaaacttccaattgaagacactgagctgaaccattccgcccgcccgcccgcccgagggcactccagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttg

SEQ ID NO: 3005 - DNA, 1552 bp, Homo sapiens
acccgcaccctcggcggccgcagcctcagcaccgcagagcggagagcggagcccggagcccgccgccccagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcagtgtaacatgtatcccgttgcctgttgttcggttgtgtgactaattgtggattttaagctgctattattgtatttcagtggcaatggacacattagccttttacaagaggactagagttcatcaagccttgaaaggcaggcttcacagtgccgagttggcgggaaaagcaaattcttttgaagtcttagtcttt

SEQ ID NO: 3006 - DNA, 3227 bp, Homo sapiens
ggccgggattcgcggcccggagctcgggaccggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccaggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacacgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 3007 - DNA, 740 bp, Homo sapiens; identical to SEQ ID NO: 1924

SEQ ID NO: 3008 - DNA, 3821 bp, Homo sapiens
ctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcagtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaa

SEQ ID NO: 3009 - DNA, 3107 bp, Homo sapiens
aaaaacgaaagaagcccacagttgggacgaggattccagttttgcgtcaccgtcaaggcgggaaagttcccggctgtcggttggagggtgggtcctcgccccgccccgccccctcgggccgcccttccgcgcttccgggaggcttgtcccaagctcacggacccctcgctgggtgccggttaagaccccgctccccgtcgccagtgctatggaggcggcggcggcggtggtggcggcagaggcggaagtggaaaacgaagacggcgacagcagctgcggggatgtatgcttcatggacaaaggcttgcagaggacttgaagaactaattaatctgactagactaaatgtatcttataaccacatagatgatcttagtggattgattccccttcatggaattaagcataaacttagatatattgatctacatagtaatcgtatagatagtatccatcacttacttcagtgtatggtaggattgcacttcctgaccaatcttattttggagaaagatggagacgataatcctgtctgtcgactgccagggtacagagcagttattctccagactttgccacagcttagaatcctagattgcaagaacatatttggtgaaccagtaaatttgacagaaataaattcatcacagctgcagtgcctagaaggtcttttggataatttagtttcttctgattctcccctaaatataagtgaagatgagatcattgatagaatgccagtgataacagcacctatcgatgagttagttcccttggaacagtttgcaagtacaccaagtgatgctgtgttgacgtcttttatgtctgtgtgtcaatcttctgagccagagaaaaataatcatgaaaacgatttgcagaatgagataaaacttcagaaattagatgaccaaattctacaacttctaaatgaaacttctaattcaatagataacgttcttgagaaagaccccagaccaaaaagagacacagatataacttctgaaagtgactatggaaacagtagaaaaaatggagagacaaaaaaggcagcagcaggcagcacagataagactgatccaagaggtggaactcaaagcttcagctgccgatagagaaatatacttacttagaacttcccttcatcgagaaagagaacaagcgcaacaacttcatcaacttcttgcattgaaagaacaggaacacaggaaggaacttgaaacaagggagttttttactgatgctgacttccaggatgccttagctaaagaaatagccaaagaagagaaaaagcatgagcaaatgataaaagaataccaagagaaaattgacgtgttaagccagcagtatatggatttagaaaatgaattccgtattgctttaactgttgaagccagaagatttcaagatgttaaagatggttttgaaaatgttgcaactgagttagcaaagagcaaacatgctcttatttgggctcaacgaaaagaaaatgagtcttcctctttaattaaagatctgacctgtatggtaaaggaacaaaaaacaaaactggcagaagtttctaaattgaaacaagaaacagcagcaaatttacagaatcaaatcaacacccttgaaattttaattgaagatgacaagcagaagagtattcaaatagaacttctcaagcacgaaaaagtccagcttatttctgagctagcagccaaggaatcactaatatttggtttaaggacagaaagaaaagtatggggacatgagctggcacaacaaggatcttctctagcccaaaatcgtggaaaattggaggctcaaattgagagtttatctagagagaatgaatgtctgcgaaagacaaatgaaagtgatagtgatgcattaagaataaagtgcaaaatcatagacgaccaaactgaaactattagaaaattaaaagattgtttacaagaaaaagatgaacacatcaaaagattacaagaaaagatcacagaaatagaaaaatgcactcaagaacaacttgatgaaaaatcttcacaactggatgaggtacttgagaagttggaaaggcacaatgaaagaaaagaaaaactaaaacaacagttgaaaggaaaggaagtagaacttgaagaaatcagaaaagcttacagtacactgaatcggaagtggcatgataaaggagaacttctatgtcatcttgaaacacaagtaaaagaagtgaaagaaaaatttgaaaacaaggaaaagaaacttaaagcggaaagagacaaaagtattgaactacaaaagaatgcaatggaaaaacttcatagtatggatgatgcctttaaaagacaagttgatgcaattgttgaagctcatcaagctgaaatagcacagctggccaatgaaaagcagaagtgtattgattctgcaaatttaaaggtccatcaaattgaaaaagaaatgcgtgaacttttggaagaaacatgcaagaacaaaaaaacaatggaagcaaaaattaagcaacttgcttttgctttaaatgaaattcagcaagatatgtgatggttctgagaatgaatttaattgaaatagaccagcagacctattgtaaaaatgattaaatattgtaatagtagtaactgctatgactttgaaatgtctctttctatacatttcattatgaatatatttttaaagacttttgatcaagtatttattaattgtataggttttttataataaattgttgacaattttgtctattagaaaaaactatcataactagacttacaatatttttcttgtttctgtactatacattgtttggtaattacacatttgcctacaaatttgtgaatgaaaagattagtattttcaccatatgaggtaaaacattttaatcattgttatcttattgtgatgatgaagaactaattatatttgttatttaattgatgtagctcaattcttttaaagtacttatgtagccaaaaagcatttgaaatctgtatgataaaagatgtggcattcttaagaaagtatatgtagccatctccacatcactcattatgaccccttcttttataatgcttatatcttttcattaaagattacatttaaggttttataaa

SEQ ID NO: 3010 - DNA, 2757 bp, Homo sapiens
gagcggcgacggcggcggcggcgggcacagattaattaaaagaagaatgaactataatccttgaagataactgggcaattttttaagtcggaggctgttcttactggtgtgaggatttacacacgtcttcagtttttcagcacagaccagcagaccatcatttttagaggaaatactccctctgccctcctttttggtttccttggtgggctcaactaaaaaactgaatgggatgggagatgatggcagccccccagcgaaaaaaatgataacggacattcatgcaaatggaaaaacgataaacaaggtgccaacagttaagaaggaacacttggatgactatggagaagcaccagtggaaactgatggagagcatgttaagcgaacctgtacttctgttcctgaaactttgcatttaaatcccagtttgaaacacacattggcacaattccatttaagtagtcagagctcgctgggtggaccagcagcattttctgctcggcattcccaagaaagcatgtcgcctactgtatttctgcctcttccatcacctcaggttcttcctggcccattgctcatcccttcagatagctccacagaactcactcagactgtgttggaaggggaatctatttcttgttttcaagttggaggagaaaagagactctgtttgccccaagtcttaaattctgttctccgagaatttacactccagcaaataaatacagtgtgtgatgaactgtacatatattgttcaaggtgtacttcagaccagcttcatatcttaaaggtactgggcatacttccattcaatgccccatcctgtgggctgattacattaactgatgcacaaagattatgtaatgctttattgcggccacgaacttttcctcaaaatggtagcgtacttcctgctaaaagctcattggcccagttaaaggaaactggcagtgcctttgaagtggagcatgaatgcctaggcaaatgtcagggtttatttgcaccccagttttatgttcagcctgatgctccgtgtattcaatgtctggagtgttgtggaatgtttgcaccccagacgtttgtgatgcattctcacagatcacctgacaaaagaacttgccactggggctttgaatcagctaaatggcattgctatcttcatgtgaaccaaaaatacttaggaacacctgaagaaaagaaactgaagataattttagaagaaatgaaggagaagtttagcatgagaagtggaaagagaaatcaatccaagacagatgcaccatcaggaatggaattacagtcatggtatcctgttataaagcaggaaggtgaccatgtttctcagacacattcatttttacaccccagctactacttatacatgtgtgataaagtggttgccccaaatgtgtcacttacttctgctgtatcccagtctaaagagctcacaaagacagaggcaagtaagtccatatcaagacagtcagagaaggctcacagtagtggtaaacttcaaaaaacagtgtcttatccagatgtctcacttgaggaacaggagaaaatggatttaaaaacaagtagagaattatgtagccgtttagatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatagaaactgttaaagagattcatctgtgtattactgacaaggttttttttgtttgttgcttgctttggtaattgaattctgaagaatttatctgcatgacgataactaggcattctatccatttgtagatcagagaaagtgaagagattatatattagtacttaaatttttacattttccaaatgaatgaaaatgtatgtttctttgtacttttttaaaaaaatcagcttagtaacaatactatatggtttcaactagtaggtaatctgcttatatttctaatgcaaacttaacaattgtgtactttttaaaagctgcaatatgtgttggaaaatagctgtggtcaattttgttatccatatttcagactcaattttagatacaatggtggctttatattttaagtatatagagctactcaaggagttgaatctccccttttctcattaacacaatttttctaagttgatatggtgtactcattaacatacaccaaatttacttttactttgttcagattgtggaatgaattt

SEQ ID NO: 3011 - DNA, 1435 bp, Homo sapiens
agggctaggggaggatggcgaggagatgggtaggagagacctggtgtctggaggaagcaatgaaggaaatgggaaggaagactgggccatgaaaacagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacctcctttcagctgctcctgggcctcagctctgcccagggccagccaggttctgctgggaagggaagggaatggggagaagggagaagcaagcagtgtctgagcctca

SEQ ID NO: 3012 - DNA, 5275 bp, Homo sapiens
aaacgtcgggaagaggcgccaaaaggatgctgggcctggctccttgaagcccgggttttcccttttgagagccacaaccaagaaataaaaatctagcaaagagggggccactttctgcggcgagatacgccctctcggccgctcctccagctcccaggccccctccctactcgacggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcagtgtaacatgtatcccgttgcctgttgttcggttgtgtgactaattgtggattttaagctgctattattgtatttcagtggcaatggacacattagccttttacaagaggactagagttcatcaagccttgaaaggcaggcttcacagtgccgagttggcgggaaaagcaaattcttttgaagtcttagtctttccctcagtagcggtttctttcaggttaacaagaggcatttgtgcacacacacagggctcttgtgtgtgttgtcaaggggaccctccgtggcctcccgtgagtgcatgcctgtagtgcacagtgtctctacaggtgtcttctggggggcagaaccaattggaaggaagaaagggacccctctccagtcctggctccttcctacatcctgggctcctgaagaagctgtcttcccattttccatgcgctgtgcttatgtgtggtggactgcagagctgcttccacttacaggagagctgataatttgttagctggaacctattcacttccgagattcagacatagccatgctggtggccttctgaatcactgcatggatgtcccaggaggcagctctccccacacagcagcacagccatcacaggattccttgtgtagaaatgattcccagtctagttaccaacagctagtctaggagtaattgaatggccctatggcacagttccacccacagagtagtgaatctctcagccaaggagggaaagaaaaggaagaactcttgactatttagattctagttaaatatctggaatcctagcagtcactacattatctcagcagagagactttaattaaactgatttgtttccaatgtcgggttcacttaaaggatttgacttaccaccagagcatagaaaagcatgcaaggaagaccagatgggcttagcattgggaagacagagggcaaggaggtgatagatggatatagaagcatttctctgcaggataccagttcaggccccaccattcctgccaaggccattacatcccacaaacccaaatacaaagcagctgacttccctggatcttccccccactcctcacacctcacatgtcccaggagctgccttcattcaggcgggtagctgcactgggcatggggtggtggtgggagcttaccgccacctattcaagctctcagctactcctgaaacgggcagagatgatgaacagaagtgtatgtaaatacagcagctagtgggagagcaccagttgggcctaatcctgcctcatcattcttggcaggaatctgcaaatggaaacattgtgagtatcagcaatctgggaagtgacagggttaataactccttcccagaagctgtatcatgagattttgaggggaccgagccctgttacatggatgtgaacagtgaggatcagaggttttatcagaacacattctttttttctaccaactctccagagcgtgagtataggagtgccatgagctttttagtcagcagttttgtaaactctgtatataaaatcattaaccacacattgtgggtgatgggaagacgatttcagctgacagagttaatggcaaccaataatggtggcctgtagctgctaagagcttcacgcaggtttggcctgggctttcactgttggtgaatttagagtgtccttttaggtggggcggctattctaaaagtgtctttctatcactgttaagggggggggaaagtgaggttcgaggatgacgtaggtaactctcccctcccaagtccatgttccaagtggctatgtaaagcaagatgatacagaaagctgctctaaaatctcactgagtgatttcaccttcgcctactatgaaatgtctcatcagacctgacatgtctgagataaccaaggtgattcaggatttgatcaaaagaagtctagtaagaattaattacacagaagcctcctttcatttctatgggccaaacaaaggccatggataaccctacccgctttatgtcattacccattgggaaacacaatggctacttctgttagggtacattgaccttggtcaagcatcttaaagaaggcaaccctaattgagagctgtcttggctaatactctgcaccacaattgtgatgtcctagtcctaccactagagggcatggtacagcctggcaaaagttaaaaggggtgtggcagctcccatcaggtctggaggtggtctataagcacagttgacagttgtgcattgggatgggtggagaaagacgacaagagagcagagaatctgctgatgtggctgcgcttacttttagtgactttatgtacttatattaacagctggaaataggttgttgggttttgagcaggctgttatagtgaggaatgttcatttttaaatgttcctaacagattttgcttttgaaaaatgcttgttacatgaataatttgtggaccagggattgcttttctgaaggcagtatagggaacatgaatattcaagatgaaatacaaaaattatgtttaagggtcatagtgtataagtagcttcctaggaaaccctttgtgtatcttttcagactggggtgggggctgagcatgcttgtgcagaaagaagccatagccagaaaggacagaatctctcccccactcccttgccccataaccaaacataagctagctagtcttgtctaatagatgggatttactataggtgaagatagccctcatattcaaggacagaagctctggcaggagtaaattagcaaagcagaaatagtaccctttcattcttggaggtgctttgaaattttaggtagaatataatcgaaattatggaggttccttagtgctcaataatataagacctggtgttattagaacgagtctttcttataaactaacagagcaggtatatgcctgttagaccttagctgtggggttcctttactattgggtgaatcattaggtataaaaaataatcatcaaccaggcaaattactttgcttcctagctgatgtcatcccacattggtacaggtgttattcagtactgggtggttcagcagggaagccgggtgggaccagtgtgtctgtcatgaaaccactaactgcattcctgactgaagagccatctgtcatttattggggaaggtcttcagttgagctctcagccttaggaaggaagcacgtggaggagggacggaggaggttcccttgctgggcatgcttcgtagagggccaggagcagcaggtcatgtgcacatgccgttgcagcacaagcttatgcttcccgtagccgtggcttttcattctgcacagtcccaggtcccagctcccctcttatggtttctgtcataatgtgctttatctgattgactccaaacatcccgaaatgtcacctgcagatttctcgtgggaaccaatatgtacatgtttgcaattatgctgtgagaatttaaatgtgttagatggaaaatgctattggcagggaataataataaaaaaaaaagaaaatcattctgtttcctgcagtgggaactggccatgtagtcttaacagtcttttgtacaaatatctacaaagcagataatatccctatccagtgcttgcccttggaattgtctctaaatgcatcaagcatacaataaaaaaaactgaaattaacatcc

SEQ ID NO: 3013 - DNA, 3037 bp, Homo sapiens
aggtgaaaaattagacgatttcaagaattggagctgaatctgatgttaagtaatggcaacaggtgacttaaaaagaagcttacggaacctagaacaggtgctccgcttgctaaattatcctgaagaggtggactgtgtaggtttgataaagggagacccagcagcatctttgcccatcatcagctattcttttacctcatactcaccttatgtaacagaacttataatggaatccaatgtagagctcatagcaaaaaatgacttgcgctttatagatgctgtctataagcttcttcgtgatcaatttaattataaaccaattttgacaaaaaagcagtttatccaatgtgggtttgcagaatggaaaatccaaattgtttgtgatattttgaattgtgtgatgaaaaagcacaaggaattaagcagtcttcagaagattccatcacaacaaagaaagaaaatcagttctggtaagtcagaacctcctttgggcaatgagaaaatatctgcagaggctgttggcgttgatatcagtggcaggtttatgacctcaggaaagaagaaagctgtggtgattcgtcacttgtataatgaagataatgttgacatttctgaggatacattaagtccaataacagatgttaatgaagcagttgatgtgtctgacttaaatgctactgaaataaagatgcctgaagtaaaggttcctgaaatcaaggctgagcaacaggatgtaaatgttaatcctgagattactgcactacaaactatgcttgctgaatgccaagaaaatcttaagaaactgacttcgatagagaaaaggttagactgtttggaacaaaaaatgaaaggaaaagtgatggtagatgaaaacacctggactaatcttcttagtcgtgtcactcttcttgaaacagaaatgcttttgtctaaaaagaatgatgaatttatagagtttaatgaagttagtgaagactacgcttcttgtagtgacatggaccttctgaatcctcacagaaaaagcgaagtagagaggccagcaagtattcctctgtcctctggctatagtacagcatcatcagattcaactcccagagcctctactgttaattactgtggtttgaatgagatttcagagaattttcctgcatggagtgctacatcctcttgttccagtctcagctggctgctccgtgggcatacttcatacctttcatcacagagctttgcttggcctctctcctgtgtgtaatctctgtttcttggatcctgtgcttaccttttcctgctgtactctgatgtttcagtgaagctcatccacgaagtccagaattctgcctggaaaccagcttcctcctcagctccagctcttttaatgggcatatcaaaactgatgactttttccttcctgctacatgggtaacacttagttgtttgtctaatttctattttccagaaatttctcaaaatgtctgctgatagcccctcactcatatttttcatgtgggtttatagctttcatatttctttattattgtaaatgggggctgtggaaggtgagaaaacacatgctttcttaaaacagaagctctctccttcattaatttaaatatttttatcggctctagaaaatgcataaggttagtacaagatcagtagagagaaagtcaaagattacagaagtgctgaagcagaccattcttcctttcttcccaatgtctattaagatcacacataggtaaactgttacaaatccagaatggtgaaagagtccaacaatggctgagggaagtagaggttaagatatagctcaacagtgaaagtagcagggaaagagctgggcaaggccaagaccatcttttgtaccgttggtacagtaggctaaaggtacggtgttccatattaaatacagcaatatgaagaaaaataaattaagtcccttatacctaagacctctatttctctgttgattacatacacagtggcaatggaaagaagggaaaataatggggatagcatttgctcattctctgaccatgcaacactggcagcattctatacttattctattaactgcatcaaccacatcttataaaacacatttccataggccatatgtaataggccttggctttattcattgcatttattggctccttaaattgacaacatataattgttttcatataattttcatcaaataaaattcactttaatttgtatgaacatatttaaagtggaaagtatcttcccaaatggtccatatcttaaagtgtcagatattttatgggcttcacatctgaactgccagagatctcaggcatagcatgcattaatcacaaccacttactgacctggttcagatacttactcaatacatggggctagacacagagtgtgccttaggctaaagaaaaaattattcaagttgagcatatccataaactctggctcaagcagtgtattttgggggtaataaacacaagtttgttcctagttggagggatatgatgcttaggtttgaacctgttaaccttcctgggtttgagggctagaaaacgtggagacattcctttctaactaacacattttctaatagaaacaatccaccaggatgttgagcccacattttaagagttcttcggaatttactgaaaatggaaaactgattacattgggcacataggacatttatatttatagaaacattttagataagacaagaattttaaaagccagaaatcacttttagtgggcattttcagaaaaatgttgtcaactttttgtaatttttaataggcataaaaaagattgttatattgatattgacagaaattaggtggttaattagagagcgtaaaaggatgaattgctctaacattggtttagaatttttctttatatgattcaattttgtggtctggcaaaggcccaatagtcatttatctagtatgcatacctttccacagctggattttcaaatatgatgataaagttcatatgacagacctattctgaaaataaatatgtcagcagg

SEQ ID NO: 3014 - DNA, 2403 bp, Homo sapiens
ctgcgcaggcgccgagcggccgaggcgccgcggtcggctctgggactcgtctggcgtccctcagaggcagaagaggcctggaccttggcgcacacagacccaggaacagatgagcagggatgtctgcatccacacctggccgtgcacctactacctggagcccaagaggcgatgggttactggacagctgtccttaacatcgctgtcgctcaggttcatgactgacagcactggagagattctggtcagcttccccctctccagcatagttgagatcaagaaggaggcttcacattttatcttcagctccatcaccatcctggagaagggccatgccaagcactggttcagctccctgcggccaagtcgaaatgtggtcttcagcatcatcgagcatttctggagggagctgctgctgtctcagcctggagccgtggcagacgcatctgtcccaaggacccggggcgaggagctgacgggactcatggctggatcccagaaacgcctggaggacacggcgagggtcctgcaccaccagggccagcagctggacagcgtcatgagaggcctggacaagatggagtcagacctggaggtggcggacagattgctgacagaactggaatctcctgcttggtggccctttagctccaagctttggaagacaccaccggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacgacatcaaggtccactcaccttacgaaattagcatccgccagcggtttattggaaagccagacatggcctatcgtttgatatctgccaagatgccagaggttatccccattttagaagtgcagttcagcaagaagatggagctgttagaagatgcattggtgctcagaagcgcaagaacctcttcccccgcagagaagagctgctcagtctggcatgcagcatctgggctgatgggccgtaccctgcaccgtgagccacccgcaggagaccaggagggcacagcactgcacctgcagacaagcctgccagccctttctgaggcagatacccaggaactaacccagggcttccggcctatgtcgctgtcaacccagacagtgttggtgatgctttgctccgagtctgcaggagctttgtggagacagagactttcctagcagggcagcaagcggaagcttttcttccagaacagcctttgctcagggcatgagggagccggccaggcccacagcgcccagggcatcctcctcacggatgtgttggaggaaagtggctttggtgctatcctgggggaccatggccataagctggcagtgtcagccacgcatcagttgcgtttctttgttcaggttgtgcctcttgctgcctgcctgagtcacccagggctgctccccttcctggctctgacgccctcagcgggtcccacaagccgctcaggaccacagagtctggccatgggtctggccaggcatccactgatgctctaagctgcagcttctcttaggaacacttctatcaggtctggctcgcaggcatgccccagggccagcctggattgtactgtccttcaagcactccttgctctatttctttgaagtttataaaagtttgtttcccccaaaacccaaagcacttttaatcaggtagtttctgtggaggtcgaactggctggaaggaaggctggttcctggatttctttactcatgtagcagggactcaaggaagtctgatttgcgcctcgcctctgactcagagcccatgaaggttcctgtgtgaggccactggctgcctcggagctgacagcatcctgcacaatggctagatggcttgtcaccccaggccgcagaggaacaactgtttctagggtttggccagacttcacattctccattctttccatccctgttatgtggaatgcacacgatgccatgtaattacttcagtcccttctcaaaggaaaaagaatctggacctgcactccaggacactagcagtttgaaggttcgctcaggaatgttctttgtctgcagacctagcagctgtacagatcgctcttgtgtttttgcactattaattaacttcaagtgcaattttggcaggcaggccaagggtctcaacaggctatttggaatgagttctcttttaaggccttcaacgtagtgagacattttcaaatcaaaaagtacagcaggagccagcctttattttgtctgtgtacacaataaaatattccgcttctataggc

SEQ ID NO: 3015 - DNA, 2020 bp, Homo sapiens
ctacacacgtgtgtgtgcgcgtgtgtataaaacacagtgcactaatactcagcctttaaaaaaaatgccacttgcaacaacgtagatggagctggacgatatcatgctaaaattatgcaaagtgaaacaagcacaaaaaagaacgagacacgggcgtggggcacgaggtgctcactgcgcaagcgcccactccaccgcgtggtttccagctggaggctgggagcgttcgtggcttcctcttttcttgctgacccttcggagctctgggaagtggctgcaccttggcggctccccagagcgcgcggtgctaatcgtgggtcgtcagcctgggtggctgggcccggcttagggcagggtttggcatttccaatggtagggggctcggaccgtccctccgcgggaccctcccgttgggacaaggccgatcgcctgggcggttggagccgctatcctggcgcgagacggtggacaagtcctatattcaagagaagataactttgaacagtttcgaaggatctaaaacgtatgtgtctgcagacatcaatgaggatgaagaattagtagaagagattaatagatcaaaaacgtttgctggctttgcaggtggtgggcctgcctgggcatcggcgcgttggaggagacgccctggggggccttagctgccctgaagcggtagacaggtggcaacgtgggggctcaggagttgacaaacacaagaaagcagcgccgaattgcaggtttatccgcagcttttattttgaagacagtgccacgaaacctgcaaatcctggtgtcccaaatagtcaataccaagttgaaaaccatctgggagaggaaaagcgttgtgctttagacaggccgtctgagactcgtgcagaccggcttttgagagctggacaggtggtggatagatcagactccatacacccgaggagccccgccatgcatagtgaagaagctagataacagtcgtttcacaactggccagcctctgcccacttgaccccgagagagctggccagtgctgggctgtactacacaggcactgatgaccaagtgcagtgcttctgttgtggcggaaaactgaaaaactgggaacctggtgatcgtgcctggtcagaacacaggagacattttcctaattgcttctttattttgggccacaacgttaatattcgaggtgaatctgatgttgcgagttctgataggaatttctcaaattcaacaagttctccaaggaatccatccatgacgggttatgaagcccggctcattacttttgggacatggatgtactccgttaacaaagagcagcttgcaagagctggattttatgctataggtcaagaggataaagtacagtgctttcactgtggaggagggctagccaactggaagcccaaggaagatccttgggaacagcatgctaaatggtatccaggttgcaaatatctgctagaagagaagggacatgaatatataaacaacattcatttaacccgttcacttgagggagctctggtacaaactaccaagaaaacaccatcactaactaaaagaatcagtgataccatcttccctaatcctatgctacaagaagctatacgaatgggatttgatttcaaggacgttaagaaaataatggaggaaagaattcaaacatctgggagcaactataaaacgcttgaggttcttgttgcagatctagtgagcgctcagaaagacactacagaaaatgaattgaatcagacttcattgcagagagaaatcagccctgaagagccgctaaggcgtctgcaagaggagaagctttgtaaaatctgcatggacagacatatcgctgttgtttttattccttgtggacatctggtcacttgtaaacaatgtgctgaagcagttgacagatgtcccatgtgcagcgcggttattgatttcaagcaaagagtttttatgtcttaatgtaactctacagtgggtgtgctatgttcttattaccctgattaaatgtgtgatgtgactc

SEQ ID NO: 3016 - DNA, 876 bp, Homo sapiens
ggcagcgcgggcctcggggtcctggggcgagacggtgagcgtgggggctgggccggcgccaggggcgccgtttccttcccccacgcagctccgcgcgcccgggcctccacatcgtcgctaacggagcgttgcggcgccggcgacccctggcgagcccggggcgggacagtggccaggccggcctgggcccagcgcgtggcctccgccgtttcgggctgtgctgggtggaagattaggctccccgggcacgccgtccccgccgagaggcctcagcttcgtggcagcgccctcgtccttccagcccgctcgagggtggccgccagggcgcgatgaaggaatgtgagaaagtgcttagcgctccagccgctccgagggaagccaggtgggaggagatcccgaaacgctaaggttttgacagcgttacagtgaattctccggctgtagagattggaggaagtcgggagaaattcgtctctaagttgtaagcttgttctaaagacgaaggggaactccctagtgctacaggctgtttcaggaagccaattaattttgtacacataatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtg

SEQ ID NO: 3017 - DNA, 816 bp, Homo sapiens
acctactctagggagggggctgtgctggttctgcctgggcagccccacgctgaggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccacc

SEQ ID NO: 3018 - DNA, 1846 bp, Homo sapiens
ggccttcctctcccgcttccgcctggcgtaggagctgaggcatggccttgttctccagctgagaggacgatcgtccttataggagaggccgagtctccgagggcaatttcagaggtctggtgcgagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgattttgatccaaacaatatcttcaaggcattctttggcggtcctggcggcttcagctttgaagcatctggtccagggaatttcttttttcaatttggctaatgaagggcaaccacccagaacccagaaaatgcagattcactcagtttaatcttgaatgtggaaacagttcacctcctcccttcatcacgtctccgtgtgcttagagcagtttcgttttctcagttggatgccctgtgtctctgtgagtggggtggagcaaagggaaccaatgccgaagaccgagggcaggggagggaggcgggggtggacagggaggcagcttgtgaatttttgttttactgtttaactttattaaaaaagaaaaaaaaaagagaataaaatgttttgacccttcctggccctttgctctgg

SEQ ID NO: 3019 - DNA, 1732 bp, Homo sapiens
cctctaggaccggaaaattctgggaaggctcgaggccgcggtccccggggtccgcatagtcccgatgaaaaacagacccgggaaagctggtgggagtcaggagccccggcgatgaggattgcgatgaaggaagcaggctcggagcgccgccagcgcatgcgtattggggatctgaggccagcgtcttgcgccgccattgcggggaggctgtcctcagagcaggtctggcgcgccggtggctggaccggccccaggagcccagtcaccgggcgtcattggctcaggctgcggggccctcggcaccttctccctcccgggtccaccgcggcggcggcggcggcggcggcggcggcggcggcggcgtcagggggcggagcctgccgaagcgccctttgtctgcggaggtcaacatacctggcctaaggaggcaggattgagtgactctcactcaccactggtgttgctctttgaaagtggcgcttggcaccagcatgaactccccatcctcagcaatcccatcaggtgttttgggtcttcaacctaaaattctatcttacaagatccttgccaggatgcagatttgaatactatagtgaagtctgtacatgaagaaatgatgcttttagggaggaaaaaaaaaggtaataacaaccttcaagagccccttcatctcaactcggcataaacaaggcaagattctgagagtggccgcccctggaagcagaaattattcttgtggctatccattggctcctgaggctctaatcagagatggggcacctttagtaccaggggagtgactgttgcccataaggtactggacatcaactttcaagagcagccccagctccttaagctgctggtcctggtgcatctgctgactttcatgtagaagatagcagagctttggcgacattacaacataagaactgcagagaggtgtaatcccagtggaagactgaatcgagagactcaaaaaggaaggaggggaacatggaggaggaagaaatgaatgatggctcacagatggtgagatctcaggaatcactgacgtttcaggatgtggccgtggacttcaccagagaggagtgggaccagctgtaccctgcccaaaagaacctctatcgagacgtgatgctggagaactacaggaatctagttgcactggggtatcagctttgtaagccagaggtaatcgcgcagttggagctagaggaagaatgggtgatagaaagagacagcctgctggatactcatccaggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagcacagtgaagcgggagtggaagaaggatctaaagggaaaaactgacatgtttatgttatggaaaaagaa

SEQ ID NO: 3020 - DNA, 926 bp, Homo sapiens
tcggcttccgaatggaagaggtctgtgagaagttaacctggtgataccgatccgaagagcctatcaagtgaagccccctgaaatacggagaataagaatcttagaggtaaatccgaggacaagcaggttgttcagcagaagtcttggagtgcattttcagtggttaaggtgaaaaaatgactactaaaaatttagaaaccaaagtcaccgttacttcatccccaatccgaggagcaggagatggaatggaaactgaggaaccacctaaatctgttgaagttacctccggagtccaatctagaaagcatcatagtcttcagagtccatggaagaaagcagttccatcagagagcccaggagttcttcagctagggaaaatgctcactgaaaaagcaatggaagttaaagctgtaagaatattagttcccaaagctgctataactcatgatatccccaacaaaaatacaaaggttaagtctctgggacatcataaaggagaattccttggtcagtcagagggagttatagaacctaataaggaactctcagaggtaaagaatgtattggaaaagctcaagaattctgaaagaaggttactacaggacaaagaaggtctttcaaaccagctccgtgtacagacagaggtaaatcgtgagttaaaaaagttactggtggcttctgttggggatgatcttcagtatcactttgaacgtctagcccgtgagaaaaatcagcttattttagaaaatgaagccctaggtcgaaacacagctcagctttctgaacagttagaacgtatgtcaatacagtgtgatgtatggcgaagtaaattccttgcaagcagggtaatggcagatgagttaaccaactcaagagcagctttacagcgtcaaaaccgtgatgcacacggggctatacaagatctc

SEQ ID NO: 3021 - DNA, 559 bp, Homo sapiens
gtgtgtacgggtgtgtgtgtgtgtgtacgccgacacgtcggtgcggaccgacgcgggggtgtcaggagctgggacggccgggggcagaactgcaaggtgtggaatatttctggcttctagtccaatgccaagtgtgtgacctgtggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaattggagctctggcagatcagcatatcattcatgtggcatgtggcgagtcccacagtctggccctcagtgaccgaggccagctgttttcttggggtgcagggagtgatggtcagctaggactcatgactactgaggattctgtggcagtgccca

SEQ ID NO: 3022 - DNA, 1754 bp, Homo sapiens
gggaaaaccaactgtaacgtgccacccaaatgtaagttttactcatattttgatgttaggatggatagcttggaaaaagttggagggtacggcctttactatgaggcatctatgaaggatcaggaatggatgtagacaaggaactaggaatggaaagtgttaaagctggagcctctggaaaaccagaaatgaggctgggcactcaggaagaaacaagtgaaggtgatgctaatgaaagctcattactagtcctgtccagcaacgtgcctctcctggccctagagttcttggaaatagcccaggccaaagagaaggcctttctccccatggtcagccacacgttccacatgcgcacagaggagtctgatgcctcacaggagggcgatgacctacccaagtcctcagcaaacaccagccatcccaagcaggatgacagccccaagtcctcagaagaaaccatccagcccaaggagggtgacatccccaaggccccagaagaaaccatccaatccaagaaggaggacctccccaagtcctcagaaaaagccatccagcccaaagagagtaacatccccaagtcctcagcaaaacccatccagcccaagctgggcaatattcccaaggcctcagtgaagcccagccagcccaaggagggtgacatccccaaggccccagaagaaaccatccaatccaagaaggaggacctccccaagtcctcagaagaagccatccagcccaaagagggtgacatccccaagtcctcagcaaaacccatccagcccaagctgggcaatattgccaagacctcagtgaagcccagccagcccaaggagagtgatatccccaagtccccagaagaaaccatccagcccaaggagggtgacatccccaagtcctcagcaaagcccatccagcccaagctgggcaatattcccaaggcctcagtgaagcccagccagcccaaggagggtgacatctccaagtccccagaagaagccatccagcccaaggagggtgacctccccaagtccctagaggaagccatccagcccaaggagggtgacatccccaagtccctagaggaagccatccagcctaaggagggtgacatccccaagtccccagaagaaaccatccagcccaagaagggtgacatccccaagtccccagaagaagccatccagcccaaggagggtgacattcccaagtctccaaaacaagccatccagcccaaggagggtgacattcccaagtccctagaggaagccatcccacccaaggagattgacatccccaagtccccagaagaaaccatccagcccaaggaggatgacagccccaagtccctagaagaagccaccccatccaaggagggtgacatcctaaagcctgaagaagaaacaatggagttcccggagggggacaaggtgaaagtgatcctgagcaaggaggactttgaggcatcactgaaggaggccggggagaggctggtggctgtggacttctcggccacgtggtgtgggccctgcaggaccatcagaccattcttccatgccctgtctgtgaagcatgaggatgtggtgttcctggaggtggacgctgacaactgtgaggaggtggtgagagagtgcgccatcatgtgtgtcccaacctttcagttttataaaaaagaagaaaaggtggatgaactttgcggcgcccttaaggaaaaacttgaagcagtcattgcagaattaaagtaaacatgtattctg

SEQ ID NO: 3023 - DNA, 499 bp, Homo sapiens
agaccgcggtgacgtctccaccgcgccaaactcactgaaaatcaaaccgctaccattaggagccctccacgcttaacatatccgttctttctcgtttgaaagtaaccaggctgctcctccccatttttcgccttcttctcgcggaggctgagagactaaccttacacaacatggcggcctggtgtgtctggtgtcctagagcggacgaaagcaggtgactctctagtcaacttccgacttggactccgaagatcggcgtctgcgctcggtttgagggctcggcgcggggtttcctgttcctccttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaa

SEQ ID NO: 3024 - DNA, 4068 bp, Homo sapiens
tcacggtggtggcgtggagacgtgggggcgcttccggcagcggcggcggtggtgaaggccgatgctgtgggggtgggcgtggagagaattcttctgtgggtcctctggtgttgagtggtcggcttggtgtggtgtgcggaggagctccaggcccgtcggcgcggaggctttcaggtataggctgggtcactagtcttaaaacatttcttcttgagaatgtctaaaagactgtggaatctgttagatcttatatacttttaagttggcacctgaaacttttcatcctagatttacatagtggtcttgctgtgttgcccagcctggtcttgaattcctggactcaagtgatgctcctgccttggcttcccaaactcctggaattacaactcaatgaatgacggtttttgttgctccacatcctcgtcagcatttggtgttgtcagtgttttggatttcggccattctgacagtggtctcacgtgtgaaacatggctacagattggctgggaagtattgtgtccatcaattgtggagatagcttgggtgtctatcagggaagagtgtcagctgtggatcaggtcagccagaccatttctctcacccggcctttccataatggagtgaagtgtcttgttccagaagtcaccttcagggcaggtgacattacggagttaaaaattctggagataccaggacctggagacaaccaacattttggagaccttcatcaaacagaattaggcccctctggtgctggctgccaagtgggcatcaatcagaatggcacaggcaagtttgtcaagaagccagcctcttccagcagtgcccctcagaatatccctaagaggacagatgtgaagagccaggatgttgccgtttccccgcagcagcaacagtgctcaaagagctatgtcgacaggcacatggaatccttgagtcagtccaaaagtttccgtcgtcggcacaactcctggtcatctagtagcaggcacccaaatcaggcaactcccaagaaaagtggtttaaagaatggccagatgaagaataaagatgacgagtgcttcggggatgatattgaggagatcccagacacagattttgattttgaagggaacctggctctttttgacaaggcagctgtgtttgaggagattgatacctatgaaaggagaagtggtacccgttcccggggcatcccaaatgaaaggcccactcggtaccgccatgatgagaacatcttggagtccgagcccattgtctatcgacggatcatagtgccccacaacgtgagcaaggagttctgcacggactctggcctggttgtcccaagtatttcctatgagctgcataaaaagctgttgtccgtggctgagaagcatgggctgacccttgagcggagactggagatgacaggtgtgtgtgccagtcagatggcactgaccctcctcggaggacctaacaggttgaatcccaaaaatgttcaccagaggcctacagtggctctactgtgtggacctcatgtgaagggggctcagggtatcagctgtggaaggcacctagccaaccatgatgtccaggtcatccttttcctgcccaattttgtcaagatgttggaatctatcaccaatgagctgtcgctcttcagcaagacccaaggccaacaagtgtctagcctcaaagatctgcccactagccctgtggacctggtcatcaactgcctggattgccctgagaacgtcttcctgcgcgatcaaccctggtacaaggcagctgtggcctgggccaaccagaaccgggcaccagtactcagcatagaccctcctgtgcatgaagtcgaacagggcattgatgccaaatggtcactggcactgggcctgcctctgccactgggggagcacgcaggccgtatctatttgtgcgacattggcattccccagcaggtcttccaggaggtgggcatcaactaccactcgccctttggctgcaagtttgttatcccactgcactctgcttagagggttcctgcgcaggcaggactctgctgtcccctgctgctcctgataacaaacgccttaaggatatgaagcttcatggaccttgttaaagttttttctcttttgggtttgtttcttctgtgagagaacagaacttacttaaaactgacctgtcacttgctcttagccagggaagtctttcccactgggttccgggctgggtggcaggctgagcgtgcagcaactccaggcatctctaccctcagccccctgcacggccaggtgggcctttgtttacagccgtaggcagctctcaagactgtgtttcaggtttacagccactgggcctgggcacacacattgaagagtgggccaggtcctgtctgggggcctgtacctgctctatttcagagcttgtggctttgtgtctcccctgctttccccacgcagacagcccttcctctgtagaaccagctgcacggcagctgtccaccagagggcagacctgcactctccattcatgtccagggctgtgacagaccaggccttcccctagccccacaagttgatttggggggttttgacccttactcctgagctgatccaagttttatgctgatttttccaaggatctctccctccttttccctccatcactcagaggtagggaagggggcggcattaggatggtgttactgtattgggattttatgttgttctgtcgtcttcagcacaggtagtataaggttatattactgtagaaccacagtgcccatcttgccagcagtgcccgcccccaccctcaaagctgagcaggttgagcctttgcctagtctggggccagacccctcagatggggatatccctgggggagcctggtgctgaaccagaagaggcttcctggtgcttctgtcctaggccaccactcctccagccctttgcccgcacatacatgccccacctactctttcatcccctctgcccttcccctgaaacggtcctttgcagctgtcatcccagagcaggcagatgggctcccgtgcttgagctccaccccagctcttacatcatctgggctttgaaccttttacatttgtccagtctagatgagtaggcttggggccagcaccctgtctcaaagatggcaaaatgaggctagttctggatgagctagctggtgtgggttccaaccataggaacacactgatgctcaaatcctaaggtgccaagctctaggccctggaggctggtagaacaggatctatgcctggaatcctggcagggattcctgtcaaggacttgtgtttaagcctgcttcagggcttcaggctgcttctgctctgtgtctgcccaggctggctgagcgggtggatgggtggacagaagggctcaccaaggattgtggacatagggtaggccctggtaccacgggtttcaggctgttatcacttcccttgtaggaacatagccagaagcagatgagccagggtagagggctggcccctcctctcatcttcccttcagtcttaaattgtctccagcgatgggaagaggccagggactgtaacccttgtgctgtgtattctctgagcctctgctcactctcagggccaagcagctcccaagccggggccctctcttggccaaaatctgaggagcagtctaggttacaggctttttggtaggtaggttctggctgcctgttaatgcagttaggccccctgattaggtacagtgagaaacaagctagaacaaccctggcccagaagactgtccactccagcaagatccagggatgatagccttgcagggccactgggagtttgtgcccaagcttctccctcttctctccccagggggcactgggactggtccctgccctcatccttagcctgggccttccccagaggtattaaagagaagtatgattcctctgtcttcagttcttttcaggggcatcctgcccatagtacccagttcccaaggggcccccagtcacgtggtgaagcctagcactcatgcagctcttagggaaccaaaaaccagcactgaaataaagctgaatgactgactg

SEQ ID NO: 3025 - DNA, 4112 bp, Homo sapiens
aaacattaaagcctaacctgaggtaatccctcaccggcagtgaagctcctctgctaggcactgtcgtcccgtacactgcccaagctctgggggtgtcacactaaactgtggtgatgtcacactagctgggatgacattttacagttggatcccgtaccaccgccaggcacctttaaatcaccgcagagtctgcagtgcggagggggcgggaagtccaggccccgcactcgatccacgctggctccctacggaggcccacctactcgaggcccaccgactcctactgcaatcagtactatgcgatcgtcctagagagtccattcagctgcacttccgcctcagtatggcatcacagctgcaagtgttttcgcccccatcagtgtcgtcgagtgccttctgcagtgcgaagaaactgaaaatagagccctctggctgggatgtttcaggacagagtagcaacgacaaatattatacccacagcaaaaccctcccagccacacaagggcaagccaactcctctcaccaggtagcaaatttcaacatccctgcttacgaccagggcctcctcctcccagctcctgcagtggagcatattgttgtaacagccgctgatagctcgggcagtgctgctacatcaaccttccaaagcagccagaccctgactcacagaagcaacgtttctttgcttgagccatatcaaaaatgtggattgaaacgaaaaagtgaggaagttgacagcaacggtagtgtgcagatcatagaagaacatccccctctcatgctgcaaaacaggactgtggtgggtgctgctgccacaaccaccactgtgaccacaaagagtagcagttccagcggagaaggggattaccagctggtccagcatgagatcctttgctctatgaccaatagctatgaagtcttggagttcctaggccgggggacatttggacaggtggctaagtgctggaagaggagcaccaaggaaattgtggctattaaaatcttgaagaaccacccctcctatgccagacaaggacagattgaagtgagcatcctttcccgcctaagcagtgaaaatgctgatgagtataattttgtccgttcatacgagtgctttcagcataagaatcacacctgccttgtttttgaaatgttggagcagaacttatatgattttctaaagcaaaacaaatttagcccactgccactcaagtacatcagaccaatcttgcagcaggtggccacagccttgatgaagctcaagagtcttggtctgatccacgctgaccttaagcctgaaaacatcatgctggttgatccagttcgccagccctaccgagtgaaggtcattgactttggttctgctagtcacgtttccaaagctgtgtgctcaacctacttacagtcacgttactacagagctcctgaaattattcttgggttaccattttgtgaagctattgatatgtggtcactgggctgtgtgatagctgagctgttcctgggatggcctctttatcctggtgcttcagaatatgatcagattcgttatatttcacaaacacaaggcttgccagctgaatatcttctcagtgccggaacaaaaacaaccaggtttttcaacagagatcctaatttggggtacccactgtggaggcttaagacacctgaagaacatgaactggagactggaataaaatcaaaagaagctcggaagtacatttttaattgcttagatgacatggctcaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcatgttaagtcttgttttcagaacatggagatctgcaagcggagggttcacatgtatgatacagtgagtcagatcaagagtcccttcactacacatgttgccccaaatacaagcacaaatctaaccatgagcttcagcaatcagctcaatacagtgcacaatcaggccagtgttctagcttccagttctactgcagcagctgctactctttctctggctaattcagatgtctcactactaaactaccagtcagctttgtacccatcatctgctgcaccagttcctggagttgcccagcagggtgtttccttgcagcctggaaccacccagatttgcactcagacagatccattccaacagacatttatagtatgtccacctgcgtttcaaactggactacaagcaacaacaaagcattctggattccctgtgaggatggataatgctgtaccgattgtaccccaggcaccagctgctcagccactacagattcagtcaggagttctcacgcagggaagctgtacaccactaatggtagcaactctccaccctcaagtagccaccatcacaccgcagtatgcggtgccctttactctgagctgcgcagccggccggccggcgctggttgaacagactgccgctgtactgcaggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaa

SEQ ID NO: 3026 - DNA, 2441 bp, Homo sapiens
accctgatcagggagtatcggctgcgggtgcgcaaggcgtccaggagtgacctggggctgtggagagcgacccgtggccttgtgtttcaggtacggaggttccggactggacgggcgtcaggaagtcacagacttgtcctctgatgtggccccgcccgccgccgcactaatctcttcggcgtcgtacccgtcggcccagctcgacccgccgcagccccggccccgaccgtggacactgggggtccccgagggcgctgcgacctcctcccgggtgaaatgaaacccgagggcagtcccccttaccgaccccattagagacgtatctgccgtgccaggggtctaggctccagaaacagggagtttaccacctaggatgacttcagtgactagatcagagatcatagatgaaaaaggaccagtgatgtctaagactcatgatcatcaattggaatcaagtctcagtcctgtggaagtgtttgctaaaacatctgcctccctggagatgaatcaaggcgtttcagaggaaagaattcaccttggctctagccctaaaaaagggggaaattgtgatctcagccaccaggaaagacttcagtcgaagtcccttcatttgtctcctcaagaacaatctgccagttatcaagacaggaggcaatcctggcggcgagcaagtatgaaagaaacgaaccggcggaagtcgctgcatcccattcaccagggcatcacagagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttcatcta

SEQ ID NO: 3027 - DNA, 2767 bp, Homo sapiens
cgagcgcggcgaggggcgcatgcagggccccgacgcgccactgctcctgagcgcgagggagctggggcccgggcgccggggctcggcctcctggtaccgccaggagggcggcgcggtgtgcaactggctgcggaagccgcagccgctcgagccacgcaccagtttcccctcggcgcgccgctccgagttccgtccacccaggaggctgccatgggccggccctgcctccgcccagtccgaggagggtcacgcaggcggcagatgccaggcgggcagccccgcccctgcgcgccgcctcagcggcgccttcaagacgctggtcccaggcacccacgcccagggcgcctcggatacccaccccctcggccccccgcacaccccggtcctcgacccctctccgcaggatggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggtgggtctatgtctcaatctccggaatttgccgtggtttgatgaggttgatgccaactccttcttcccacgctgctactgcctgggggctgaggatgacaaaaaagccttcatagaggacttctggctgactgctgcccgcaacgttctcaagctggtggtgaagtctgagtggaagtcataccctattcaggcagtagaggaagaggcctcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcctgctgtggaggtgcctcaatatgtgggcatccggctcctggtagagggcttcaccatcaagaagcccatggcgatgtgtcatcggcggatgggggtccgcccagcagtccctctgctgacccagcgaggctctggggaagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagtatttggggcttgactccattgctgttggagggtcaagagtggatggggcgaggccgtgtaccccagggtccacagcaagagcctga

SEQ ID NO: 3028 - DNA, 3239 bp, Homo sapiens
ctttgaactccaagctgctcaagaaaaagaaaagcttaaagttgaagatgagcctgaagtcttgacagaacctccaagtgccacaaccactactaccataggtatatctgcaacctggacaactttggcaggttctcatggtaaaagaaataataccataactacaaccagttcaaagaggaaaaacaggaaaaataaaattactccagaaaacgttcaaattatatttgatgatccactaccaatttcatacagtcagccagagaaggtgaatggagagtccaagagcagcagtaccagcgagagtggggacagtgataacatgaggatttccagctgcagcgatgaaagtagtaacagcaacagcagtcgtaagagtgacaatcattcaccagctgtggtcactaccactgtgagcagcaaaaagcagccatcagttcttgttacatttccaaaggaagagagaaaatctgtttctggcaaggcttcaataaaattgtcagaaactatcagtgaagggaccagtaattctctatctacttgtacaaaatctggtccatctcccctttcttctccaaatgggaagttaacagtagcaagtcctaagcgtgggcaaaagagggaagaaggatggaaagaagttgtaagaaggtcaaagaaagtatctgttccatcaactgtgatatccagagtgattggaagaggaggctgtaatatcaatgctattcgggagtttactggtgcacacatagatattgataaacagaaagacaagactggagaccggataatcactataaggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctaacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcagaatagcagtggttctcaggtgaattcagcaggttctttaacttcaagcccaacaactacaaccagttcatcagcttcaacggtgcctggtacatctacaaatggcagtccaagttcaccttctgtccgaaggcagctttttgtcacagttgtgaagacatccaatgccaccacaacaacagtcacaaccacggcaagcaacaacaacactgcacccacaaatgccacatatcctatgcctactgccaaagaacactatccagtatcatccccatcttccccatcaccaccagcccagccaggaggggtttctagaaacagccctttggattgtggatcagcatctccaaataaagtggcatcttcctccgaacaggaagcaggtagtccaccagtagtagaaacaacaaacactagacctccaaacagcagcagttcttctgggagttcatcagctcattctaatcagcaacaacctccgggatctgtttctcaggaaccaagaccacctcttcagcagtctcaggttcctcccccggaagttagaatgactgttcctcctttagcaacaagttctgctccagtggcggtgccttctactgccccagtgacttaccctatgcctcagacaccaatgggatgcccccagcctactcctaaaatggaaacccctgctattagaccaccccctcatggcacaactgcccctcacaagaattcagcttcagtgcaaaattcatctgttgcagtcctcagtgtcaatcacattaaaagacctcacagtgttccctcttctgtccagctaccttcgaccttaagtacacaaagtgcttgtcagaattcagtacatccagcaaataagcctattgctcccaatttcagtgcccccttaccatttgggccctttagcacattgtttgaaaacagccctacttctgctcatgccttctggggaggatctgttgtttcatctcagtcaacaccagaatctatgctatcaggaaaatcctcatatttgccaaattcagatcctttacatcagtctgatacttccaaagctccaggttttagaccaccattacagagacctgctccaagtccctcaggtattgtcaatatggactcgccatatggttctgtaacaccttcttcaacacatttgggaaactttgcttcaaacatttcaggaggtcagatgtacggacctggggcaccccttggaggagcacccgcagctgctaactttaacagacaacatttttccccgcttagtttgttgactccgtgttcatcagcatcaaatgattcttctgcacagtcagtatcctcgggagttcgtgcaccatctcctgccccatcatcagtaccgttagggtcagaaaagcccagcaatgtgtctcaggacatagtggcatctggtcctttgaagggattggtggcaatcaagacaaagtagactggtgtaaccctgggatgggaaatcctatgatccacagaccgatgtctgacccaggagtattttcacaacatcaagcaatggagcgagatagtacaggaattgtaactccttctggtacattccatcagcatgttcctgcaggctacatggactttcctaaagttgggggtatgcctttttctgtgtatgggaatgcaatgattcctccagtagcacctatccctgatggtgctggaggacccatatttaatggccctcatgctgcagacccttcttggaactcactgataaagatggtttccagctccacggaaaataatggccctcaaacggtgtggactggaccctgggcacctcacatgaacagtgtgcatatgaaccagcttggctgatgaggatcagcttgttagcctgcagattccttttcatttggaggaaatcacaagtggcc

SEQ ID NO: 3029 - DNA, 7593 bp, Homo sapiens
gaggcggtggcggcggaggcggcaccgattgctgtgtcggccccagtgcggccgaagtcgcggtagagcgtagccccacgcccctcccccgtccgcgccctccctctttccctggggatggagaaggcgacggttccggtggcggcggcgacggctgcagaaggagaagggagccccccggcggtggcggctgtggcgggcccccccgcggcggcggaggtcggcggcggcgttggcggcagcagcagagctcgctcggcctcgtctcctcgtgggatggtgcgagtctgcgacctgctcctgaagaagaagccgccgcagcagcagcaccacaaggccaagcgtaaccggacttgccgaccccccagcagcagcgaaagcagcagcgacagcgacaacagcggcggcggtggaggcggcggtggaggcggaggtggcggcggcggcaccagcagtaacaacagcgaggaagaagaggacgacgacgacgaggaagaggaggtttctgaggtggagtctttcattttggatcaggatgatttggaaaatccaatgctggaaacagcttccaagttgctcttatcaggtactgctgatggtgcagacctcaggacagtagatccagaaacacaggctagactggaagctttactagaagctgcaggaataggaaaattgtccacggctgatggtaaagcctttgcagatcctgaagtacttcggaggttgacatcgtctgttagttgtgcgttggatgaagctgctgctgcacttacccgtatgagagctgaaagcacagcaaatgcagggcagtcggacaaccgcagtttggcagaagcctgttcagaaggagatgtaaatgctgtgcgaaagttactcattgaagggcgaagtgtaaatgaacacacagaggaaggggagagcctcctttgtttagcttgttctgctggatactatgagcttgcacaggttttgttggcaatgcatgcaaatgtggaagataggggaatcaaaggtgacattacacctttaatggctgctgctaatggaggacatgtcaaaattgtgaagttgctgctagctcataaagcagatgttaatgcacagtcttcaacaggcaatacagcacttacatatgcttgtgctggaggctatgtagatgttgtaaaggtgctcttggaatccggtgctagtattgaggaccataatgaaaatggtcatacccctcttatggaagctggaagtgctggacatgtggaagtagccagattgctgctagaaaatggggctggcattaatacgcattctaatgaatttaaagagagtgcccttaccttagcttgttacaaaggacacttagagatggtgcgatttcttttggaagcaggcgcggatcaagagcataaaacagatgaaatgcacactgctctgatggaggcttgcatggatggccatgttgaagtagctaggttacttcttgacagcggtgcccaagtgaacatgcctgctgattcatttgagtcaccattaactttggctgcatgtggtgggcatgtggaacttgcggctttacttattgaaagaggagctagcctggaagaggtcaatgatgaaggttatacaccattgatggaagcagctcgagaaggacatgaagaaatggtggcattacttcttggtcaaggagcaaatatcaatgcacagacagaagaaactcaagaaactgccttgactctggcttgctgtggaggctttctggaagtggcagactttctaattaaggcaggagccgatatagaactagggtgttctacccctttaatggaagctgctcaagagggtcatttggagttagttaaatacttattagctgcaggagctaacgttcatgcaacaacagcaacaggggatacagcactaacatatgcctgtgaaaatggtcatactgatgtagcagatgtcttacttcaggcaggcgcagatctggaacatgaatctgaaggtggaagaactcctttaatgaaagctgcaagagctggtcatgtttgtactgttcagttcttaattagtaaaggagcgaatgtgaatagaaccacagctaataatgaccatactgtactgtccctggcttgtgcagggggtcatctggcagtggtggaactacttttggctcatggggcagatcctactcaccgtttgaaagatggctcaactatgttgatagaagcagcaaaaggtggccatacaagtgttgtttgctatctcttggattatcctaataacttgctttcagcccctccaccagatgtcactcagttaactcccccatcccacgatttaaatagggctcctcgtgtaccagttcaagcactgcccatggttgttccacctcaggagcctgacaaaccacctgccaatgttgccaccactcttcccatcaggaataaagctgcttctaaacaaaagtccagcagccatttgccagcaaacagccaggatgtacagggttacatcaccaatcagtctccagagagcattgtagaagaggctcagggaaagttaacagaactggaacagaggataaaagaagccatagaaaagaatgcacagctgcagtccttggaactggctcatgctgaccaacttaccaaggagaagatcgaggagctcaacaaaacaagggaggaacaaattcagaagaaacaaaagattttggaggaactacagaaagtagaacgagagttacaactgaaaactcagcagcagctaaaaaagcagtatctagaggttaaagctcaaagaattcaacttcagcaacagcagcaacagtcttgccaacacctgggattactaactcctgttggagttggagagcagctttctgagggagactatgcacggttacagcaagtggatcctgttttacttaaagatgaaccccagcagactgctgctcagatgggttttgcgccaatccagcctctggcgatgcctcaagctttgcctctggcggcaggtcccttgcctccagggtccatcgcaaatcttacagaactgcaagtcctatcatctctccttcagccatgcttcctatctaccctgccattgatattgatgcacagactgagagtaatcatgacacggcccaagagcagcagtaccagcgagagtggggacagtgataacatgaggatttccagctgcagcgatgaaagtagtaacagcaacagcagtcgtaagagtgacaatcattcaccagctgtggtcactaccactgtgagcagcaaaaagcagccatcagttcttgttacatttccaaaggaagagagaaaatctgtttctggcaaggcttcaataaaattgtcagaaactatcagtgaagggaccagtaattctctatctacttgtacaaaatctggtccatctcccctttcttctccaaatgggaagttaacagtagcaagtcctaagcgtgggcaaaagagggaagaaggatggaaagaagttgtaagaaggtcaaagaaagtatctgttccatcaactgtgatatccagagtgattggaagaggaggctgtaatatcaatgctattcgggagtttactggtgcacacatagatattgataaacagaaagacaagactggagaccggataatcactataaggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctaacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcagaatagcagtggttctcaggtgaattcagcaggttctttaacttcaagcccaacaactacaaccagttcatcagcttcaacggtgcctggtacatctacaaatggcagtccaagttcaccttctgtccgaaggcagctttttgtcacagttgtgaagacatccaatgccaccacaacaacagtcacaaccacggcaagcaacaacaacactgcacccacaaatgccacatatcctatgcctactgccaaagaacactatccagtatcatccccatcttccccatcaccaccagcccagccaggaggggtttctagaaacagccctttggattgtggatcagcatctccaaataaagtggcatcttcctccgaacaggaagcaggtagtccaccagtagtagaaacaacaaacactagacctccaaacagcagcagttcttctgggagttcatcagctcattctaatcagcaacaacctccgggatctgtttctcaggaaccaagaccacctcttcagcagtctcaggttcctcccccggaagttagaatgactgttcctcctttagcaacaagttctgctccagtggcggtgccttctactgccccagtgacttaccctatgcctcagacaccaatgggatgcccccagcctactcctaaaatggaaacccctgctattagaccaccccctcatggcacaactgcccctcacaagaattcagcttcagtgcaaaattcatctgttgcagtcctcagtgtcaatcacattaaaagacctcacagtgttccctcttctgtccagctaccttcgaccttaagtacacaaagtgcttgtcagaattcagtacatccagcaaataagcctattgctcccaatttcagtgcccccttaccatttgggccctttagcacattgtttgaaaacagccctacttctgctcatgccttctggggaggatctgttgtttcatctcagtcaacaccagaatctatgctatcaggaaaatcctcatatttgccaaattcagatcctttacatcagtctgatacttccaaagctccaggttttagaccaccattacagagacctgctccaagtccctcaggtattgtcaatatggactcgccatatggttctgtaacaccttcttcaacacatttgggaaactttgcttcaaacatttcaggaggtcagatgtacggacctggggcaccccttggaggagcacccgcagctgctaactttaacagacaacatttttccccgcttagtttgttgactccgtgttcatcagcatcaaatgattcttctgcacagtcagtatcctcgggagttcgtgcaccatctcctgccccatcatcagtaccgttagggtcagaaaagcccagcaatgtgtctcaggacaggaaagttccagtccctattgggactgaacgttctgcacgtatcaggcaaactggaacgtcagctccatctgttattgggagcaatttgtctacatcagtaggacatagtggcatctggtcctttgaagggattggtggcaatcaagacaaagtagactggtgtaaccctgggatgggaaatcctatgatccacagaccgatgtctgacccaggagtattttcacaacatcaagcaatggagcgagatagtacaggaattgtaactccttctggtacattccatcagcatgttcctgcaggctacatggactttcctaaagttgggggtatgcctttttctgtgtatgggaatgcaatgattcctccagtagcacctatccctgatggtgctggaggacccatatttaatggccctcatgctgcagacccttcttggaactcactgataaagatggtttccagctccacggaaaataatggccctcaaacggtgtggactggaccctgggcacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcaatatgtcagtatagaggctctactttatgtagacttaaattaatgtgagatatgtaccttcatattcagaaatctggatgtttccttcatacattaaactattaataagcataacttttctactggtgtaatttaagtataaagtaaaataatgggcattatcattggatgtttccccacattggcttttaaaatacccatcttgctttctttttggtttatttgtagcaaggcacatatagaagaagaaatttctggcttttccatgttgttttattaccttttctcacttttaaaactaatacagacttatctcctcactcctttttctctccttacctttaccactaataccagtaaaattatctttctgatagtgaaaaggttctgtcaagattttcactgtaatggctgctacagagatggaccatcttcatcatcaccagtggtttcttctaattataaaatgtttaaactttctgagaatttaaaaagccaccactgttcccagtcagcatatacaagctcttaatattctgtttattaaataattcaatgtactattttatattggatgatattgattcttaacattggcttttcagtcatcaacagtcaacataaaaatttcaattttcagtaatttagtggaaaatatcttatttcttttttcaattttaaaggcttcctgcttttttacccttgtatattatcagtgaaaaggatcaacagttaatttgagccaagtaataaaagaaattctgcatttgtcacgaagacaatttatggtagacagataaatacacagattacagtgtaaagtctccatttaacctgtttataaaagatacaaggccacactaaactactcagtgggatttatatattccatccacttgaaacaataaacagtaatgtatccaagaagattatgtgtcctaccctgtctcatggaaaaattaattatatggttgaaatgtaaaagaaagtaagcataaaaatcgagtaatgt

SEQ ID NO: 3030 - DNA, 3546 bp, Homo sapiens
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtggtgagtatagacctggcccatgggggcagctgcaccgtgggcgtggtgagcgaggatgtgcagcggaagggggagcttcggctgcggccagaggagggggtgtgggctgtgaggctggcttggggcttcgtctcggctctgggctccttccccacacggctgaccctgaaggagcagccccggcaggtgagggtgtctcttgactatgaggtgggctgggtgaccttcaccaacgctgtcacccgagagcccatctacaccttcactgcctccttcactaggaaggtcattcccttctttgggctctggggccgagggtccagtttctccctgagctcctgagaaggagcagttacctactctcctctaagtacaggactcatatcaacccaagtaccatgtggacttgatccctggctgaatcacctggatgacttggaatagaaatgactgctttagaagatgggatggggccgggtggtaagggatagaagagaggactctcaatctactgatcaagtcctttccccaatgcccagtggatggccagggtacctggggactcaggctgctgccagttctgctcaccaccatccgtgcttggcacagaagtagctgcatagaaagggcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaatagtgaccatgttttattttcttgttcttgtcactattgtattttattttgcataatcatgcccttcactgacagtctccttaacatcatctgtttactctgctcagtgtaaactacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattagagattgaattgctttccctgggagtgtgcagtatctcattaaaatgttgtatattcaaaaaaatacagacacacacaagtgcctatataatgataaaacatatccaaagcacccaaacctgtgattccagaaaagtagatcctatttttgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 3031 - DNA, 4726 bp, Homo sapiens
gtcacttccggtcgacggcggaaggcggaaggcggagcggtccctgcaacccggccggcgggaactgccttctagtttttagtctcagaccagaccaccgggcgcaccccgatgccgagcccgcagcttctggtgctcttcggcagccagacaggcacggctcaggatgtgtcggagagactgggtcgcgaggcccggcgccggcggcttggctgccgggtgcaggccctggactcctacccggtggtgaatctgattaacgagcccctggtgatatttgtttgtgcaactacaggccaaggagacccccctgacaacatgaagaacttctggaggtttatattccggaagaacctgccctccactgccctctgtcagatggactttgccgtcctgggcctcggggactcctcatacgccaagttcaacttcgtggccaagaagctgcaccgacggctactgcagcttgggggcagcgccctcctgcccgtgtgcctgggcgatgaccagcatgagctgggcctgccctccaagttcaccctgctgttcctccaagaggcacccagcacgggctctgaggggcagcgggtagctcaccccggctctcaggagcccccgtcagagtcgaagcccttcctagcacccatgatctccaaccagagagtcaccggcccctcccacttccaggacgttcggctgattgagtttgacatcttgggctctggcatcagctttgctgctggtgatgtggtgctgattcagccctccaactcggctgcccatgtccagcggttctgccaggtgctgggcctggaccctgaccagctcttcatgctgcagccgcgggagccagatgtctcctcccccacgaggctgccccagccctgctccatgcggcacctcgtgtcccactacctggacatcgccagcgtgcctcgccgctccttcttcgaactcctggcctgtctatccctccatgagctggagcgggagaagctgctggagttcagttctgcccaaggccaggaggagctctttgaatactgcaaccggccccgcaggaccatcctggaggtgctctgtgacttcccgcacacagctgccgccatccctcccgactacctgttggacctcatccccgttatccggccgagggccttctccatcgcctcctcgctgctgactcacccctcacggctgcagatcctcgtggctgtagtgcagttccagactcgcctcaaggagccccgccggggcctctgctcctcctggctggcatccctggaccctgggcaaggacctgtccgggtgcccctctgggtgcggcctgggagtctggccttcccagagacaccagacacacctgtgatcatggtggggcctggcactggggtagcccccttccgagcagccatccaggagcgtgtggcccagggccagactggaaacttcttgttttttggctgccgctggcgggaccaagacttctactgggaggctgagtggcaggagctggagaagcgggactgtctgaccctcatccctgccttctcccgggaacaggagcagaaagtatatgtgcagcaccggctccgggagctggggtcgcttgtgtgggaactgctggaccgccaggcaacgccaagtccatgccagcggacgtctcggaagccctgatgtccatcttccaggaggagggtggactctgcagcccggacgcagccgcgtatctagccaggctccagcagacacggcgcttccagacagagacgtgggcctgaggcccgcggctgcccgtgccccctctgacagccatcctcctgggagcccaggaaggcatccacgagggagctcctggccagcagccgtcatcctctcggaccagccagctggtcctctgggaacagccagctcccgagcacagccgcactcctgttgaccctggatcccaccctttgagcctgaccccactgcagcctctgcccagccagccctgcgctcccccaccctgacagtgagctgtgtcctcgtccccccacccccttcccagtcaaggtggtggcctgggccgctccacctcaccggtgcagtgacccaggacggcatcagcagcccagtgagcaccaggggtggcatagggcacccatgaggctgcgctgcactcctctgccctggggccacctcggctgctgcagcctgcccagcagcacattccagtcactgcccccgcactcccacagggctcaggctgggctcagaggccactgagatgccagctccttgagagcagtgggggtgtcccaggccagagcagcctcttcctctcctggtcccagaaaaacccttgcagtaaatggtggcctctgggtggttacttctagcgcaggcttccttccttcctctagctcctcccggtgccctgggtgctgggtgctggatggatgggcgtcctctagctcctcccggtgccctgggtgctgggtgctggatgggtgggcgtcctctagctcctcccggtgccctgggtgctgggtgctggatgggtgggcgccacggtgcacccttgttgggctgcctgtgcccgagtggcctctgcagctcttatgtctgcctctaatgggatgtgcgccctgactgcctcgttcttaagggcatagtgggtcggctaagatctgatcgccaggactgcgttctgggcaggtgctgggaaggcggaaccaagccgtccgtgccgctagggagccgagactgccggaaagaggagcggcaggagggggcgtggttgtgcagccccacccccgggaggggctttaggcactgggaaggaaagtcctgttggaggagttcggtggctgttcacacccgcctcgctgtcttggagtcttgatctgtcgtcggcgggtcgctggcacaggactaaacatggctgaggctgggctccagccagatctggctggggacagcaccgcgtgggcccaggatccacccagagcaggcaggccttgctggggccccagtcaagtccacttccagtgaggagagccagccgggaggtcagtgccagagctctggtggagcccagaccctgccttccctgagggccgcccctgtcgccgccctggggtccctgtcctcctatcctgactcctgccccagggccaccacccctgaactgtgccctggggcccccaccctccacctggccgactccagctctgggcctgtcagtccacctgggtcctctctgggccctgagtgcctggaccctctgtgccaagcaccagcaagcaaaggggatgaccttgggcacccccaaggtgctgagactacagccagtgagcccctgctgggggccaaagccatggagggtgcctgggcccttccaacctggaaggaggaggggagagagcaggcagcagggcagggggaagaggaggagtgcccgatctgcacagagccctacgggcccagagagcgccgcctggccctgctgaactgtagccacggcctgtgtgtgggctgcctgcacaggctgctgggctcggcctccagtgccgacctgggccgggtgcgctgcccgctgtgccgccagaagacgcccgtgctggaatgggagatctgccggctacaggaggagctgctacaggccgacgggccctcacgccagccccgccgagaggcccctgcatcctatcaccgcaaccctgggccctggggctccctggagcaccgctaccagctgcgcttcctggcagggcccgtgggcggccggggctgcctgcccttcctgccctgtccaccctgcctgggtgcccggctctggaccctgcgggagcggggaccctgtgcccgccgcctggcgctgctgagcctgctggcccttgagcttctggggctgctgctggtcttcacgccgctcctgctgctgggactgctcttcgtgctcctggaccgctctggccgctgagcagagcccaggacagccccgccgccaacaggccagggggcccagactggcccacgtccccatgcctgggtgctgtgaggcctgatgaccaggctggaaaaacccaaggttgggtccagggcaggggccttcaatcaagacctcccattgctgaacccacaaccagggctacccagaggcctgaccctgccagagtccatggctgcactgctgcccagacactagctgaacccaaggacaccagcgcccaaggacagctcctggaggaggccagcccagcaggaaagtctgtgagcaggaccccattcaccctgcggcagacgggcaccgtactggccacgggctgacgccggccacacttcccctccgagggccagctgagcacagcaggcatgaaagcaaacagagatacagcagtgagtcagttccttggagagggcagggactccgcccaccctgtgttcagataagggccagtgtgtgtccctgaaggtcaggccagccgggggaggggtccatgctgcgaaaattcagcctgcaaaggctcctctccccacttgatcaggcccagaccaggtgggggttggcgctggcctgtgttgcaggggacaagggcccacccaggccttggaacataagctctgcccctgcacaccctcatgtcaccacacctgggatggagacatcaggtggcccagcgagagatggaggactgatcctggaacgtgaagcagctttcaataaaccagctcctgggga

SEQ ID NO: 3032 - DNA, 2119 bp, Homo sapiens
ggcagccctccccagtggagccccgaggacccttttatttctgcaggttattgcttgatgacttgggaatgaattcttgggacagaaggaagaattttcatctattgaagaaaaattcaaaattattgagagagctgaaaaatttggactcccgccagtgccgtgagacacacaaaatcgcagtgttttacattgctgaaggtcaagaagacaagtgttcaatcctctctaatgaaagaggaagccaagcatatgaagactttgttgctggacttggatgggaggtggatctctccacccactgtgggttcatgggtggccttcagcgcaatggcagcaccgggcagacggccccttactatgctacctcaactgtggaagtgattttccatgtttccactcgaatgccgtcagactcagatgattccctcaccaaaaagcttcgtcacttggggaatgacgaggtccatatcgtctggtctgaacactccagagactaccgcaggggtattatcccaactgcctttggagatgtttcaatcattatttacccaatgaagaatcacatgttcttcatcgcgataacgaagaaacctgaggttccattttttgggcctctgtttgatggagccatagtgagtgggaagctgctgccaagccttgtatgtgccacgtgcatcaacgccagcagggctgtgaagtgcctcatcccactctaccagagcttgtatctttttgctttaaatgtgtaacttactaaccatcccagaatcaagattcctggcagtttttcataagaggtaagtattcaaaactgaattgaagagggaagagaatttttttcaacctctgttaaaaataacatagtggtttttcatagcatttgttaatttatattaaatataataattttatgctgcattaaacttagagtttactttcataatttactcacatacgtttgtgtctgagaagctgtgaccattatgagatgctcatatcttcttaggtattttgccccacgttcagtctcatcctgtatccctcttatttgtggcagtccattgtatataaggtgggatgctgagcaaaacgtatcgctcattcagagtgcctaccagaaaccaaagcaaatgaaatgaccctaataaatcaaagaatgtggcaggtaccacctgagaagtgcaagtaggtttctggaagatcagaggagatagaaattgcatttggttgagggtagagggaaagatgtcctgaattaagttgcatttggacttatcaataggaatagctagaaattcttttgtaattttcccaaatcattgatattttctctagttcctgattttgtttccaaaaacagaataaatttcactcctaaaattttttcctcaaacattaattggcctgctgtagtccttaaattcaagcatgatctcaagttataagaaaaagagattaagatgggtgaccttataaaattgatgcaaaaaaagtgacctcctaataaaacttagaatctctttgtttctaattggtattgataataatttgaaacatattgtgtttgacctctatatatacttctcccaacctgatagtaagtgatgtgttgctatagcaagtgagagttgggggtagatgaaaactatcccatgtgaatagatacggttcatgaaaaaatacctttcattaaaatcctggtcacttcattgactgatattctgcctttagattaaaaaaaaatacatatgccatgtggcaacttaaaattatcatagaaatgagtagtagaaaagagctattaggtcccatctggtccctcccctgggggccagggcaggattattcccttcagtgtactctctcgtgctttgtccaggctggtggtgagtgttttggagatggcattctttgcagtgatttccacaacactgtagacgtaatcttgtggctggtgtcaatttggccttcagcatggagtttttatttcacatactattaaaaagagcctcttggcagaaatgagaaagaactattcagcgattagtttgtcagtttgcatgtcaactaggacgagctgggcacgcatcagtcaagtatgttggaccaaggcagc

SEQ ID NO: 3033 - DNA, 562 bp, Homo sapiens
gttgtgagctgcggcagagactggtggctggaggagacgccggcgctggagagtgcgctgcgccgcccgccgctgagggaccgcggggttagccactgctggctgcttccagtgttcgccgagaggtaccgggggtgacagctccgggaccggccgaaagccacataaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttccttgccatagagctgtgctctcagcctgtagcagctacttcagagctatgttttgtaatgaccacagggaaagccgagaaatgttggttgagatcaatggtattttagc

SEQ ID NO: 3034 - DNA, 1958 bp, Homo sapiens
cctggagttccggccaggccactgcttgggaagcaagaaggtgaaggcacctctgctgggccaagcactcttagggccgaggggcactgcagctgacaagagctccctgtttcgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagaacatgcccaatgtccgtgatcatgatgcctctgtctacctccgcctccaaggggatgccttgtctgtgggtggctatgaggccaaccccatcttttgggaggaggtgtcagacaagtttgccttcggcctctttgacctggactgggaggtgttcacccagcacattgaaggcgccatcaacagggtccccgtgctggagaagacaggaatcaagtccacggtctgcggccctgaatccttcacgcccgaccacaagcccctgatgggggaggcacctgagctccgagggttcttcctgggctgtggcttcaacagcgcaggaatgatgctgggtggtggctgtgggcaggagctggcccactggatcatccatgggcgcccggagaaggacatgcatggctatgacatcaggcgcttccatcactcgctcacggaccacccccgctggatccgagagcgaagccatgagtcctacgccaagaactactccgtcgtcttcccccacgatgagccgctggccgggcgcaacatgaggagagacccgctgcacgaggaactccttggacaaggctgcgtgttccaggagcggcatggctgggagcgaccgggatggtttcatccccgaggcccagctccggtcctcgagtacgactactacggggcttacgggagccgcgcgcacgaggactacgcctaccgcaggctgctggcagacgagtacaccttcgccttcccgccccaccacgacacgatcaagaaggagtgcctggcctgcagaggggccgccgctgtgtttgacatgtcctacttcgggaagttctacctggtggggctggatgcaaggaaggctgccgactggctcttctccgcagatgtcagccgacccccagggctccaccgtgtacacgt

SEQ ID NO: 3035 - DNA, 623 bp, Homo sapiens
gagactgatttgccccatgggcctaagacataagctgaacctctggcctgcagttccagatccaaggtgactgagacaaactgccagctgccactggcttatcaggagcacctgggctatcttagtttccactgctgcagcctgtggcctggacatttgcccatggttgtgaggtccccatgcatgggacttcttcctcctgactccaggcttcagttcacccatcaggccttaaagcatcttcggccctatcttgccctgaactttttgctgcaaaaaccaagggcactgcctcaagcttatcttcccagccactgtttactgctgctacattgttgcccaagacacttcagaagtgactgttgttgtcatctcctgccaagtcctggaaggcaagccaccaagtcccatgcaccattcccacagcccgacaaccttcctgactctacccactggaatctaaagagtctgcccacttctggatgtttgttcaggagatggacaacatgtctcccaggctgagagccttcctctccgaacccattggagaaaaggatgtctgctgggtggatggcatcagccatgagctcgcgatcaatttggtcaccaaaggtatcaataag

SEQ ID NO: 3036 - DNA, 3411 bp, Homo sapiens
aatcacagggctgcggccgagagagaagccttattagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgtta

SEQ ID NO: 3037 - DNA, 3229 bp, Homo sapiens
gcgaagtgaagggtggcccaggtggggccaggctgactgaatgtatctcctagctatggactaaataatacatggggggaaataaacaagtattcatgagggtgaaaatgtgacccagcaggaaaattacaactattttcaattgacgttgaataggatgagtcatggaatttaagtgatttactgaagattatactactggtagatagaagagctaaagaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgctgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaaatgaa

SEQ ID NO: 3038 - DNA, 554 bp, Homo sapiens
attgcctctcaccccccggaggggttattttgggggtggttggaggcggtggcggcggcggcgaggaggggaatttccttgtgcctccattcccgggaggggggagcggcgttggaggccaccgtttccaggtgtgggaataagtatctttggaagaccaggcactttatgcagtattgagctcaggaggcagtgagtgttaaggaatgggtgtaaaacatcaacaacagcaacttgtgattggcggtgaccggatattcagttgcacatccccacatcaatgcactgccaatgtgggattacagctaagtattacgttttaaaggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagc

SEQ ID NO: 3039 - DNA, 666 bp, Homo sapiens
gggaacggacgctcagggccccggtggcctgggtgcacgcgcccgccgtgcaagggatgctcccggccgcccccggttccgcggctccatctgggatgcggcgaggagggcagccgagctgtccgcaaacaacgggcctttagttttcaggtggcgaaactgactggtctggttagagcgcgtccaagccaagccgcagtgctgtttggatttttaaatttctccttctgagtgagaaaatagcaatcgagatggaaccatccgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccag

SEQ ID NO: 3040 - DNA, 8036 bp, Homo sapiens
aaaagggcggtggggcggggggcggggcagggagagggagagaaatccagcagacatctagctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatgtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagttgctcaaatgctctcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaacctattccagaataagttttgtgttggcttgtgaagcattgatgtcattttttttaattgtggactatttagatgtgtttgtgttcagcaaaatgtgatgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtcctttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcctaatacttgtttctctctctgcgtgttgtattgttggtagtcattatatgttggtgatacatctgcacacctcactgtttcacgtatctgtttttttctctatgttgtgtaaaaagatacagtcgattccacttaagtgaatatctgatttggggaagaggaaactgcacagcagccacctttgatttatgtacaaccgcccacttgaactcctgcttccaagatttatacacttttttcctacagttcacctcagtaactgcctttggggttggatttgccaaggtgttttacggtcttttgaccacacaggttaatttccccttctctcccctccctcatgagtctatccacgcagttcttaacatacattccaaactgctgcggggtttcctctccacacccacgaggccaaacccgcatcattacagtccaactcttcttagacactaatcactttctaaaagaagtgagttctccagggaagaaaaatcaacttagccagtgaaaagggttaaacttaagtctattatttgttgccctcaatcaaaagatatgtatagaaaagtcatttaaattatttatttctacaagctaattgaatccaggagcagctttaattattaacactaacggaagagaaaagaagtatttccaagggctcaaatggaagctgtactcagtccggtggaggcagggggaggtaaagtttctcacactcaagtcgtcttcatagtttactgtccttttccaaacaaaagctaataacgccatacgcatccacacactccctcctggatgaacctaagtctcgtccccactgtcaccccaaggccagttatcaaaaactgttccttctctgccctcaaagactgaagccgcaggccctgttctgcctctgctcaggaatctgattgctcttaaagtgctcttacaagattccgtcgatgtttgctccctctgtcttatctctccttccagtattttcagacgcacaagctctgactcaggccacccagcacctggcagccttcctctgcgtgccagtgaaatctctcccagtaggtgctcaggctcttcaccctctcgttgcagcagcccctctggcccgagattgtattttctagtctgctcaagaacagaggggcctggcgaggtggaggaagggaggctccctccccggggctggccgcctcagtgatggtgatgccaccagctccagcctgcacggatggagctcacttcctaccatcacttctgctttcagtctcctcatagccttcggcagtctcctctgaaaacacactgcctacgttagtgggaaaggatggctaagggtgtgatttctttttattagggaggtgggagggggatgttgggaggcatggggggtgattaaattatcatttccaaggtgcaagtgtttatttttcaaatctataagtacatagttccaccattttggcacaagacaaaatactcatgctaagcaaaggaagagaaagacaaagccagtttttgttgcttttctaaagcaacaaataattctccaaagaaggggatgaaaatgctagttcctttaagcacttactgactgtaaagttggtccctgcttaaattcatacccatagttttgagtcggtatgacaccactgcagtgtgagcaaggtgaatccgtgtgccatgcatggaccaccttgggataccgcagcaccatcaacatccgccttgctgatggaagccacacacgctgcccagcccacagcagtcgcacgcagccgatgggctcggactcttagctggcaggctaggacacacagtgaacattaatgtactgtgaatcgttcctgataagtgaataaaacattgtgaccaaacaatcagcttattcacttatcaggaatcgactgttctgctaatttgctgttgttgtttttcatctctgttgtagttcactatttttgctgtgttctgttttctcctctcatgcttgggcaaatcactgggaatattatcttcatgtgaccatgaaacgtttctattgagtgaaaatgatatcttaacaaaatctatgcacttgctatcaggaacacaatactggatgtgtcttatatatattgaactatatagtactcgatttcttaaataaagcttaagaaaggactctgttgtgtgtaaagttaatgtgattatttttcaaagcagtgtttctaaggggtatttttgttcttttaagtcttgagtgatacaggatatttttcattaaaattatatcactggctttatgacttaatattcaataaattgactttgg

SEQ ID NO: 3041 - DNA, 568 bp, Homo sapiens
agatgccgccgaagcgtctagcgggaagggcgccggcgcggctggagggtctcagtacagggtctctgagcctgttgcccaatctggagtgcgatggtgcagtcacatctcactgcagccttgagctcctggactcaagtgattctccacctcagccttcctcatagctaggactacagctttgtaggcagccaatcccagagaagcagacgggatggctagttcagcccgggagcacctgctttttgtgaggcgtcgaaatccccagatgcggtacacattgagcccagagaacctccagagccttgccgcccagagctccatgccagagaacatgaccctgcagcgggccaacagcgacaccgacctggtgacttctgagagccgctccagcttaactgccagcatgtacgagtacacgctggggcaagcccagaacctcattatcttctgggacattaaagaggaggtggaccccagtgattggattggactttatcatatagatgagaattctccagccaacttctgggattctaagaacaggggtgtgactggaacacaaaaa

SEQ ID NO: 3042 - DNA, 3318 bp, Homo sapiens
gggagattacggggcggggacgagctgtcgcgctggttgctcgtgcaggagcgggacccggaacagaccgccgtgagagaggaggggcgccggccgggattcgcggcccggagctcgggaccggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccaggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacacgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 3043 - DNA, 568 bp, Homo sapiens
gatgcatttagtgttttcatagataggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggc

SEQ ID NO: 3044 - DNA, 2031 bp, Homo sapiens
agccagcccaggcagggcgctgaatcggcacaaaccagtctcacttcttgtaccgcagtggggaggttggagagaattttttcccatgaaagggcatacgttgcccgtccccttccccgaagaacgcactaggaatactgttcctgcgtttgcatgagctgtggcaccagcaccgactcagccttccgggcctccctcatgcacggagcctctcactaggtctcacccgcggctgcgttggtgccgtccggcacggtcacgtgggcgagaaaatggcggcccccagaccgcactgcgggcgtcgcggcaggtgaagcggtggtggcagaggcgcctgcggttactggccgggccgacgggtcctgagtctccagagctcggttcttacatccccgcgtccccaggtttagcctgagcagggttgtggaaggccgggacccattgacagcacgatggtgacggagcaggaggtggatgccatcgggcagacgctggtggaccccaagcagcccctgcaggcccgcttccgggcgctgttcacgctgcgtgggctcggcggcccaggcgccattgcatggatcagccaggccttcgatgacgattccgccctgctcaagcacgagctggcctactgcctgggccagatgcaggatgcccgcgccatccccatgctggtggacgtgctgcaagacacccgtcaggagcccatggtgcgccatgaggcaggggaggccctgggggccatcggggacccggaagttctggagatcctgaagcagtattcctcggaccccgtcatcgaggtggccgagacctgccagctggccgtgcgcaggctggagtggctgcagcagcacggcggggagccggcggcgggaccctacctctccgtggaccctgccccgccggctgaggagcgtgacgtggggcgcctgcgggaggcgctgctggatgagtcccggccgctcttcgagcgataccgcgccatgttcgccctgcgcaacgcgggaggcgaggaggccgccctggcgctggccgagggtctgcactgtgggagcgccctcttccgccacgaggtcggctacgtcctgggacagctgcagcacgaggcggcggtgccccagctggcggccgccctggcccgatgcaccgagaaccccatggtgcggcacgagtgcgcggaggccctgggcgccattgcccggcccgcctgcctggccgcgctgcaggctcacgcggacgacccagagcgcgtggtgcgtgagagctgcgaggtggctctggacatgtatgagcacgagaccgggcgggccttccagtacgcggacggcctggagcagctgcgcggggccccctcctagggccccaccctcacccggagctcccggaggactcttgagggccgctcctcccccgcagagctttggcgtctaaaccgggtgtgtgtaaatcggtgtcatcgcttgtgtcttgctgggcgcatggttgctgtccccctcctccgtctgggaccgaggagctgccgttgtgctgtgactccctgagtcccctgactgctcctcggggcctggcgcagggctgtagcgtggaagtttccaggcttggggtgggactctgcgggaggctctgggatgcccggctcaggacaggggaggattgcgagggaagccaggggaggatcgcgagggaagccaggggaggatcgcgagggaagccaggggaggatcgcgagggaagccaggggaggatcgcgagggaagccaagggaggatcgcgaggggagccaggggaggatcgcgagggaagccaggggcagagctggggctctgggaagaggctgacgttatggtggcttcagcttcactaggaatgggacacagggtctgggggcctctgactcccccaccccgaggcctgggtagggacagggtggtggtccctgagtgggtcaggtagggcacaggggccagggagggacaagcagacctcagagcgctgcccagatggaatattaaattatttttgccaagc

SEQ ID NO: 3045 - DNA, 3104 bp, Homo sapiens
tccgacattggagatttctaatccctttcctttatcatgtgtctgtattgtgtaccctccttcatttccgaaattcaaacaaacaaaaaaagccagcgtctaaaaggccagatggccgatagcggacccctcctcctgcccccaatttcaagcttaaagtagccagcgtggattctgatttcaaaatagaagatgagttgtcacactccctggaccatttcttcagcacaacacagttttagggggagcctcaggatatacgtgcacatgtccttgggccaggatgtccgtactaagccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaaggctataactcagatgacaacctctgtgagccatccctggagtttgaggtccccaaccacaggcagtacgtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccacctcggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattaggatgcaatgacaaactgacttcccccaaagcagacactactccagtatgtcccagtagaacactcatttgcaatgtgttgagctccgttaagcacacacacactcacacaacaggcttacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccg

SEQ ID NO: 3046 - DNA, 1135 bp, Homo sapiens
gcactaggctgaccgcaaccggctgaccacacacagtcctcactcccctggccctggtgggcggcaggcaccatggcgcagacagtgccgccctgcgagctgccctgcaaagagtacgacgtggcccgtaacacgggcgcctacacgtcctccggcctggccaccgccagcttccgcacctccaagtacctgctggaggagtggttccagaactgctatgctcgctaccaccaggccttcgccgaccgcgaccagtcggagcggcagcggcacgagagccagcagctggccacagagacccaggcgctggcgcagcgcacgcagcaagactccacgcgcacagtgggcgagcgactgcaggacacgcacagctggaagtcggagctgcagcgtgagatggaggcgctggctgcggagaccaacttgctcctggcccagaagcaacggctggagcgcgccctggacgccacagaggtgcccttctccatcaccactgacaacctgcagtgccgtgagcgccgcgagcaccccaacctcgtgcgcgaccatgtggaaacggagctgctgaaggcccttccccctgcactctctcagtgcctcaagaactcctgcagctcccgcaaactctctgcccgcaacaagggcacctgccaactgatggagacactgacagtgcacggagaggcaaacccagggatagaggggcgcaggacccgggccctggcacacaaggaagtacccagtggttgaggcaaagaccccaatcacagagaaaaggcttgttcctacacacagcaaattaaactggccaggcaataagaagaaacacagggtccttctcctgttcttggtgtgaagatggcctttcccagcacagagccctgaggggcagcctgggcgggcatctgggcccccagagtttgggtcctcaggggctgtccagaggccaagggcaggccaacgttcccaggtgcactgagtgagcagcagcgatgactcctgaagcctggggcgtgggaactgccgctgagggaccttcccagcagcccacagaaggccctggaggaaaacaccccacttacaacgcaccaaggagaatgcccaaaagcccaagataaacccagtgagagagcag

SEQ ID NO: 3047 - DNA, 526 bp, Homo sapiens
aaacacagtgctcacctaccgagcgcagccaggagcgcagcgccagacaattacaggagctgttttggatatggccgggcagcccagcgatgctcagcgaatcccacaactacaaccacaaccgtaccacacatttagcctgcaaaagcagagaaaggaaaagaaaaccgtgcagggaagccggaaacgagggacttaagggtctcctctctaggggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctgg

SEQ ID NO: 3048 - DNA, 582 bp, Homo sapiens
aacagaccgccgtgagagaggaggggtgccggccgggattcgcggcccggagctcgggaccggagtcaggaatggagagaagggtaatggttttacctcttattgtggaaacctgttgagatcacagagaatatactgacggcataaaagggcagaaccatagcagggtgcgaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtg

SEQ ID NO: 3049 - DNA, 1946 bp, Homo sapiens
atcgcggacgcagcctcgtgccgggagtcgccgcattgtggtccgcttctctgcactatgtcgggtggcctcctgaaggcgctgcgcagcgactcctacgtggagctgagccagtaccgggaccagcacttccggggtgacaatgaagaacaagaaaaattactgaagaaaagctatgcggaaaacgccatgcggtacataaatgggacgcgtctggatgaccgaatcattcgcacagactgggacgcaggctttaaggagggcaggcaatacggccgtgggcgatctgggggccaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacacttttagaaagacagaaaaatgtaagaatttgtttttaccataatgagtcttaagtaggttcatgatctacattggggcctgggattatttttttaattttaagtttgcatgagatagcctaataaatggaggtggggccaggcatggtggctcacacgtgtaatcccaacactttgggaggctgaggaggaaggatagcttgaggccaggagtttgagactagactgggcaacatagcaagaccccgtctctacaaagcacaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacagggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttattcggattgtcttctgtaat

SEQ ID NO: 3050 - DNA, 1162 bp, Homo sapiens
tgcccctctaccatgtggcccttcccgagccgctctctcttcccacccccgactcaggcctggctccagacggtctcctcagaccctgaggcccagggctggggggcctggaacgagaccaaggagattctggggccagagggtggggaagggaaggaggagaaagaggaggaagaggatgcagaggaagaccaggatggggatgcaggctttctgctgtctctgctggagcaagagaacctggctgagtgcccattgcctgaccaggagctggaggccatcaagatgaaggtgtgtgccatggagcaggccgaggggacgccacggcctccaggagtgcagcaacaggccgaggaagaggagggcaccgcggccgggcagctgctgagccctgagaccgtgggctgccccctctctgggacccccgaggagaaggtggaggctgaccacagatccgtctacgtgggcaacttatgcctacatagagtttgccaccaagggctccgtgcaggccgccgtggagctggaccagagcctcttccggggccgggtcatcaaggtgctgccgaaaagaaccaacttccctgggatcagctccacagaccgcgggggccttcgaggacacccaggctccaggggggcacccttcccccacagcggcctccagggcaggccccggctcagaccacaagggcagaaccgggcccgtggaaaattctcaccatggttttcaccgtattaaagggaagacccgattttgagagaggggctggggcctggatcaggagtaaaccacttgtgctccatcctggggctggggcagggagtggcgcgggggcgaggccagaggagaggggtgtccagagcagccactggccccctcttggcggggggatggcccagtagggccttgtatggtggtccagacccaaggccacagccacgagtcacagccacggcccggtggtgagcctggcatgggccccacggggatctgcggggctctgggtgttgagggaggggaggagcagagtcccaggcagtgccaggccagcttggggttggcatgctcagctcttcaactaagtcattttaagaaaaatagaaacgtgtgtcttaatggtgaagcataaattattaaacttgggctctttttaaaagc

SEQ ID NO: 3051 - DNA, 1561 bp, Homo sapiens
cttcgatgatttactgaaatttgatgacctagatggaacacatgctctgatgtcccgcatggtccagaatgagatcccctacttcatctggaccactcggcgggatgtgctcgactgtcgcttcctctccaaggatcagatgataaaccactacgcccgggctggctcctttaccacaaaggtgggtctatgtctcaatctccggaatttgccgtggtttgatgaggttgatgccaactccttcttcccacgctgctactgcctgggggctgaggatgacaaaaaagccttcatagaggacttctggctgactgctgcccgcaacgttctcaagctggtggtgaagtctgagtggaagtcataccctattcaggcagtagaggaagaggcctcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttga

SEQ ID NO: 3052 - DNA, 441 bp, Homo sapiens
tgcaagagggtgacagcaacacactcaaggcgcttctcctgggaatggagcaggagaagagatggggagcatcgcatagatggaactagacctttttcttgggttggatgatgtgttcccgcgtctactacatggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggtaaccagctctcctacacaaccatacaagctgaaacctaaacatactataaaaaggtttttaataaaatttttaaattcaaa

SEQ ID NO: 3053 - DNA, 567 bp, Homo sapiens
gttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggatttccaatttccaagcctgatgggatctcccagctggaacaggatctacaggtctttgatctggaaactaagactagagaagtcttaagagatgactgctcagatggagagaccagagaagagaacaagctgttgattcctaagcagaaaatttcggaagaagtgcattcatacaaagtgagagtaggaagactcaaac

SEQ ID NO: 3054 - DNA, 2363 bp, Homo sapiens
gatttaaaaccagctcaggagacgccaaggaaagatgggacctcccggcccaggagtattgacatttcagctactatccccaagtttacaaacacgcagattacggaacattactccacctgtatcaaactgtccactgaaaataaaatcactaccaagaatgcttttggtttgcacttgattgattttatgtcagagattcttaaacagaaagacaccgaaccaaccaactttaaagtggctgcgggtactctggatgccagcaccaagatctatgctgtgcgcgtggatgccgtccatgccgatgtatacagagtccttggggggctgggcaaagatgcaccgtctttggaagaagtagaaggccatgttgctgatggaagtgctactgaaatgggaacaaccaaaaaggctgtaaagccaaagaagaagcacttacacagaactattgagcagaacataaacaacctcaatgtctccgaagcagatcggaagtgtgagattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaagcgcccttgcagcagtgtgcagaagatcgccagatctgcccttccctggccgggttccagtttacacagtgggacagtgaaacacataatgagtctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccaggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacaagatgctccttcccaatcagaaaacaaaaagaagagtacaaaaaaagattttgaaattgactttgaagatgatattgactttgatgtatattttagaaaaacaaaggctgctactattctgaccaagtccactttggagaaccagaattggagagctaccacccttcctacagatttcaactacaatgttgacactctggtccagcttcacctcaaaccaggcaccaggttacttaagatggcccagggccatagggtagagactgagcattatgaagaaattgaagactatgattacaacaaccctaacgacacctccaacttttgccctggattacaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtcaaacttggtagctgagcctcagaaggtaaataaaattgaaattcactatgccaagactgccaaaaagatggacatgaagaaactgaagcagagcatgtggagtctgctgacagcgctctccggaaaggaggcagatgcagaggcaaaccacagggaagctggaaaagaagcggccctggcagaagtggctgacgagaagatgcttagcgggctcacgaaggacctgcagaggagcctgccccctgtcatggctcagaacctctccatacctctggcttttgcctgtctcctacatttagccaatgaaaagaatctaaaactggaaggaacagaggacctctctgatgttcttgtgaggcaaggagattgagttcactatggagaagtcagcagcaggaggcccatcccttactcagttgccgggacatccccagtctcgggggaagaagatgccatgggcttatacccaggctgtagccaactaccaacgtgcctgtttgtttgttgctctttccttctctccatcatagtctgggtgccagcgccctgaagctccgtgctcaactgattaaactttactgccctatggtgaccatctaggagaggggagggcagagggggtgagggtactattctggattgagaaaacctatatccattctttatatcaatgtatagttttagtctcctaaattgatctgttattttccaaactattctcttgta

SEQ ID NO: 3055 - DNA, 3498 bp, Homo sapiens
aactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggtaagaagaaggcggaaggcggcggaggcggcggtcgccccggggctccggcggcgggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcatttt

SEQ ID NO: 3056 - DNA, 1012 bp, Homo sapiens
gggggtcggggccgcagaagtgccagacggggccggaaagcagccgagcggagttcaaatttgagagcgtttggaaattggaagacttggtggcgaacgagggtcaggacctgcatcctgcctcagagttatcgacgtatccggaatgtgggatcagaggctggtgaagttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaacatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctatactgttgctctcctgtcttctggctgaccacacagttcatgtattaagatacttctttaactttctcaggaatgtttctcttagatccagtgagaataagatggatagcagcaatcttgcagtaatatttgcaccaaatcttcttcagacaagtgaaggacatgaaaagatgtcttctaacgcagaaaagaagggcgtgtaccagactttatcctggaaaagataccagccatgttgggtattgatggtctctgtgctactccatcactggaaggctttgaagaaggtgaatatgaaactcctggtgaatataagagaaagagaagacaacgtgtaggagattttgttagtggagcactaaataaatttaaacctaacagaacaccttctattacacctc

SEQ ID NO: 3057 - DNA, 918 bp, Homo sapiens
tcatgagagtggaggctgcggccggggctatgggcagaggtggccgggtctgcttcttccctgtcactgccgcagcagcttggggtgcaaggcggcctggggcggcggaaggggcgccccccgagttccgtctgaggaagcggcggctgccgaggaagtccacgagagccgggtcccgcacgcccctggggtccgggtgctgaggcgccgcctggccgcctccccgggccgcggcaccgctccgacccagccgccctctccaccggggccgcggcagcgccagtcggggcccttccctctaagcagcccaaacgtgcagaatgccccacaagattggatttgtagtcgtcagctcatctggacacgaagacggcttcagtgcccgggagctcatgatccacgcgccaactgtcagtgggtggcggtcacctagctacgtgtctctctgtgataatgaaaagacaggttgcaaagcccgggaactaaaatcagtttatgtggatgcagtaggacaatttcttaaactgatttttcaccaaaaccatgtcaacaaatacaacatatataatcaggttgctttggttgccataaatatcattggagaccctgcagatttcagtgatgaaagcaatactgcctctcgagagaagttgattgaccactaccttgggcacaacagcgaggaccctgctctagaaggaacgtacgccaggaaatctgactatatctctccgctagatgacttagcttttgatatgtaccaagatccagaagttgcacagatcatacgaaaattagatgaaagaaaacgggaagctgtccaaaaggaacgctatgattatgccaagaaactaaaacaagccattgctgatttgcaaaaggttggtgaacgccttgggaggtatgaggtagagaaac

SEQ ID NO: 3058 - DNA, 832 bp, Homo sapiens
caacagggaccgaccaaatcgtcatgcagctgtttggatgctttaaaaaaataaatccccacactcattacgcgttttatgctgctgacttttttatttttaagacatctgctcccgaaagctcagagccctttagcatttcattttctaaacgaatcctaatctttcctgtgactgaatcggttcagaggatatcttttcaataaggaaggaagccctcccctgctcactggggacgtcgcagggtttttaaacctaaagatttactcttttgtgcacagacgctggaagcatttggactcacttttccccttcgtctttctctccctttctgtctttctgtgtctcctccaagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgac

SEQ ID NO: 3059 - DNA, 3605 bp, Homo sapiens
gagccccagagcgcggcggcagcggcggcctggcccttccagagggccagagccagggacatgcgggcgcccgggactccgcgttccgcgcggcccggcgcctgagcgcctccgttccccgtcccggagctgccggcggcatgatccgacacgccggggcgcccgcgcgcggggaccccacgggtccggttccagttgttggcaaaggagaggaagaggaagaggaagatggcatgcggctttgtctgccagccaacccgaaaaactgccttcctcaccgccggggcatcagcatcctggagaagctcatcaaaacatgcccggtgtggctgcagctgagtctgggccaggcagaggtggccaggatcctgcaccgggtggtggctgggatgttcctggttcgccgggacagcagctcgaagcagctggtgctctgtgtccactttccttctctgaacgaaagctcggccgaggtgctcgaatacaccattaaggaagaaaagtcgatattgtacctggaaggctcggctcttgtgtttgaggacatcttcagattgattgcgttctactgtgtcagtagagacttactgcccttcacactgcggctaccccaggccatccttgaggccagcagcttcacggaccttgagaccatcgccaacctgggtctgggtttctgggactcctcgctgaatcctccacaagaaagagggaagccagcagagcccccaagagaccgggcccccggattccccctagtctccagcctcaggcccacagcccatgacgcaaactgtgcctgtgaaatcgagctgtcggtaggaaatgaccgcctgtggtttgtgaatcctattttcatcgaggactgcagcagcgccctgcccaccgaccagccacctcttggaaattgccctgcacgccctttgccgcccacctctgatgccacctcacccacctccaggtgggccccacgccgcccaccaccccctcccccagtgctgcccctgcagccctgcagcccagcccagcccccgccactgcctgcgaagaagaaccttcccactgcccctcccagacgccgcgtttccgagagggtgtccttagaagaccaaagtccggggatggcggcagagggggaccagctcagcctgcctccccaagggacctcagacggccctgaggacacgccccgggagagcacggagcaaggccaggacacagaggtgaaagccagcgatcctcacagcatgccagagctgcccaggacagccaaacaacccccagtcccgccccccaggaaaaaacggatctctcgacaactggcctcgaccctcccagctcccttagagaacgctgagctctgcacacaggcgatggccttggagacacccacgccgggtccacccagagagggccaaagccctgcttctcaggctgggactcagcaccctcctgcccaggccactgcccattcccagagctctccagagttcaagggctccctggcctccctctcagacagcttgggggtgtctgtcatggccaccgaccaggactcctactccaccagcagcacggaggaggagctggagcagttcagcagccccagcgtgaagaagaagccctccatgatcctgggcaaggctcggcaccggctgagctttgccagtttcagcagcatgttccacgctttcctctccaacaaccgcaagctgtacaagaaggtggtggagctggcgcaggacaagggctcgtactttggcagcctggtgcaggactacaaggtgtacagcctggagatgatggcgcgccagacctccagcacggagatgctgcaggagattcgcaccatgatgacccagctcaagagctacctgctgcagagcaccgagctcaaggccctggtggaccccgccctgcactccgaggaggagctcgaagcaattgtagagtctgccttgtacaaatgtgtcctgaagcccctgaaggaagccatcaactcatgcctgcatcagatccacagcaaggatggttcgctgcagcagctcaaggagaaccagttagtgatcctggccaccaccaccactgacctaggtgtgaccaccagcgtgccggaggtgcccatgatggagaagatcctgcagaagttcaccagcatgcacaaggcctactcacctgagaagaagatctccatcctgctcaagacctgcaaactcatctacgactccatggccctcggcaacccagggaagccctatggggcggatgacttcctgcctgtgctcatgtatgtgctggcccgcagcaacctcacggagatgcttctcaatgtggagtacatgatggagctcatggaccccgccctgcagctgggggagggttcctactatctgaccaccacctacggggccctggagcacatcaagagctacgacaagatcacggtgacccggcagctgagtgtggaggtgcaggactccatccaccgctgggagcgccggcgtactctcaacaaggcccgggcctcccgctcctccgtacaggacttcatctgcgtgtcgtacctggagcccgagcagcaggcgcggacgctggcgtcgcgggcggacacccaggcccaggcgctgtgcgcgcagtgcgcggagaagttcgcggtggagcggccgcaggcgcaccggctgttcgtgctggtggacgggcgctgcttccagctggcggacgacgcgctgccgcactgcatcaagggctacctgctgcgcagcgagcccaagcgcgacttccactttgtctaccggcccctggacggtggtggcggcggcggcggcgggagcccgccctgcctggtggtgcgggagcccaacttcctgtgaggccctcccggggcgcctcccctcacccccaggcgcacgtctggccccgcctctggctgcgcactcccgaccgcgacgtccacgcagcagagggacatgggccattccatgacgtgcccaggccaacgtcgcaggacagttgtgaaaataacatgacgctcgtccaaggccacttcctgagggcaagtcctaatagccctgagacaccgagacggcatgttcttcattagacggaaagggaaactgaggctcaggagagaggcgctccaggccgctgcagccaacaaaccggcgccctcttcacacgtagctcctcaggccattccccatgagtcccccacacccaccccatcctcggtctttgcaaagaagggcccgagcttagtttccccaggactggcctaggaaggagcaccggccacagctgctccccgtgccactcagggtggacccagcatctcaggagcacctcagggtgtcggttaagagacaggcctccacccctgcaccagagcctgctcttagctcccggtgcccccagaccccgcagctctgtgcccggcaagaagcagctagacacacgccagggcgccaagcacggccagctccgcggacccatggacaagcccagccccgcctcagggaaaacagggcctttccctacaggacacgccccagagctgtggcagattgcaggagccatcgtgtggggagaatttaataaaagcccttttg

SEQ ID NO: 3060 - DNA, 2229 bp, Homo sapiens
tgaaacaaaggaccaatgcccagggcggtccttaattcctccctgcagtttgaaactgtcaggttgccgtctaggtagcggttgtgcttgctgaggctgcacttgctgacactgcagctgcgacgcggctaagaggcgcagagcgaggagtcgggatttggtcgcgagcggcgacgagcatttgtgcagaatgtcatcagatgaggagaaatactcacttccagttgtgcaaaatgactccagtcgaggcagttctgtctcttcgaatcttcaggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcagggatagactccacaaataataaaaaggaagagtatggtcctggtgttcaaggaaaagaacattctgctcatttggatccttcagctcctccgatgcccttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgtatgtgccaagagttgtaacctctgcacaacagaaagcaggaagaactattacagcccggatcacaggaagatgtgattttgcttcaaaaaatagaattagcagcagtttagctataatgggagtttctcctcccatgagctcagttgttgtggaaaaacatcatccagtcacagtgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtgaatatgtccatagtggggtcttttaatccctctggtcttaccaagggttagaagtcttttggttttaacttttccatattgttagaacatcatggagacatcatgttcatctgttcaaaattacaagaggctttttcaagctctaccatgctttgtaactatatgtagaaattattttaatgttattttttatttaagcaattaagtaaaacttttttaaattaaaaaagaaactggactttatttctttaatatgtttagcctgttgctgattacagcatcaaaatatataaatttattttcacta

SEQ ID NO: 3061 - DNA, 2665 bp, Homo sapiens
gtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcatgctgttgaagcgaagtggcaaatcgttgaataaagagtggaaaaagaaatatgtcaccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagggaatgtcactagtgcatctgggtctcagatggcaagcggcatcagcctggtctccttcaacagccgacccgacggcatgcaccagcgctcctactcagtctccagtgccgaccagtggagtgaggctacggtcattgcaaactcggccatcagcagtgacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggacgaggtgaacgagacctgcggggagggagacggccgcacggcgctgcatctggcctgccgcaaggggaatgtggtcctggcgcagctcctgatctggtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcacgtgagtcccgtcgcatcccctccctcttcctggtggccacctccctcccgcccacccactctcaccccaaacaaaatcacaaaacctggacatccctcaaggggcgaagaggcggccgggagactgcagaagtggctccttttcataaactcccctaaaccacacacaggagagagcgacgggcctcggccctttgatgatagcacatggcgcaggacccttgtcctggtggcacaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactg

SEQ ID NO: 3062 - DNA, 3150 bp, Homo sapiens
gggtgggactggcagagctacggacaggtgggagcagtcagacagcctgagagagggagaccagaacgcaaagagagcgagagcattaagtaggcagggagaggcacacagaaagatagacagcaacactcgcgtgctccctccctccacacgccctcctcttaccgagcgaagcggccaggggcacagagtgggagaggactgtgggcacagaagaccggaagagggacgctgcattgctggtgggacggagggattcggacggacggacagaccagcgcacagactggcagcctgcgagagtggcagctttgagagcagagcgcagcaaagcgagaatcccgcgccgagctgctagtcggacccacagacggtcggactgacagacgtgcagacggacagaagagcagacaggaggcgggggcgcgttcactcccggcggccagccggccagagaaggcggcggtggcaccttctgagcgcgtccggagcagagaccagcagcagcaggggcagcggggacacaagccgcgaccgagccgccgccgcagccctggctgccacagctgtgtgggatcccagccgacactgcagaaagctccttttactagcagttaaataaatcgaccaaaaacaaaacaaacaaacaaacccaacaacaacaacaacaacaaaagccaagccaaaagccaaaacaaacaaatccagccaaatcaatcattgagaaacaataatattaataaaatccaaaactaaatcaaaccaatcaaggcaccaagacgcaggggggatatccacagttcgatcaaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttaccaa

SEQ ID NO: 3063 - DNA, 3216 bp, Homo sapiens
tgaggggcgaaccaagatggcggcggttttggctgtgtgaggaagacggaagagacggcggcggagggaaaccgacttccactagtccgggtcgcttgggcggccgggggccctcagagtctcccgggcagtggtagcagttgcagcaggatcaggcgcctgtcggcttctgacgtttaaaacagggggagcggaagggagccactggccgcggtggcagggccagggcccctttcctgggcgtctactggcggggcccccgccccggttcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgtaagtaagaagttaacagagcaaaaaataaccagcaaggatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattatgtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaagaaattaaaagaaagtgaggaaaaggaagtgcttctgaaaacaaacctttctggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataacctaacgttgtgctggtacctgttttaccatgtgtaatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgacttttgaataataaaaagaaaagtgaagagtaagagaaa

SEQ ID NO: 3064 - DNA, 854 bp, Homo sapiens
gaggcgtgagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggtaaagcggacattgcacaaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagc

SEQ ID NO: 3065 - DNA, 3318 bp, Homo sapiens
gggagattacggggcggggacgagctgtcgcgctggttgctcgtgcaggagcgggacccggaacagaccgccgtgagagaggaggggcgccggccgggattcgcggcccggagctcgggaccggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttctctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 3066 - DNA, 2886 bp, Homo sapiens
gtcgcgagccggtggaggacccgcgcgcggaggagccggggagtcagcgcttcttccctccctccccctctcccctccccgctccctgcccccctccccaagaatgttccgctacgagtctttggaggattgtcctctggatgaagatgaagatgcatttcagggactgggagaagaagatgaagagattgatcaattcaatgatgatacatttgggtcaggtgcagttgatgatgattggcaggaagcacatgagcgcctggctgaattggaagaaaagctaccagtggcagttaatgaacaaacaggcaatggagagagagatgaaatggacttgttgggtgaccatgaggagaatctggcagaaaggctcagtaagatggtgattgaaaatgaactagaagatccagctattatgagggcagtgcagaccaggccagttttacaaccccaaccaggaagtctgaattccagtatctgggatggatctgaagttctgaggcgaatccgaggaccactgcttgctcaggaaatgcctacagtgtctgtattagaatatgctttgcctcagaggcccccccagggtccagaagatgatcgggacctttctgaacgagcattaccaaggcggtcaacttcacctatcattggcagtcctcctgttagagctgtccccataggcaccccacctaaacagatggctgtacccagcttcacccaacagattctgtgtccgaagcctgtccatgttcggcccccaatgccacctcgttatcctgctccctatggtgagaggatgtctccaaaccagctctgcagtgtcccgctacagcctggacggatgtctcccagccagtttgcacgggtccctggatttgttggtagtccacttgctgccatgaatcccaagttgctacaagggcgagttgggcagatgcttcccccagcaccaggcttccgtgccttctttagtgctccaccctccgctacaccacctccacagcagcaccctcctggcccaggaccccacctgcaaaacctaagatctcaggccccaatgtttagaccggacacaactcacctccatccacagcaccgtcgactcttgcatcagagacagcaacagaatagaagtcagcatcggaatctcaatggtgcgggagatagaggaagtcaccggagcagtcatcaagatcatctccgaaaggatccatatgccaatctcatgttgcagcgggaaaaggattgggtctctaaaatccagatgatgcaactgcaaagcactgatccctacctggatgatttttattaccagaattactttgaaaaactggagaaactgtcagctgctgaagaaatacaaggtgatggccctaagaaggagcgcaccaagcttatcacccctcaggtggccaaactggagcacgcctataagccagtgcaatttgagggctctttgggaaagcttaccgtttctagtgtgaataatccccgaaaaatgattgatgctgttgtgacatctcggagtgaggatgatgagacaaaagaaaaacaagttcgagacaagaggagaaaaacccttgttataattgagaaaacctacagcttactccttgatgtggaggactatgaaagacgttatctcctaagtctggaagaagagcgacctgccctaatggatgacagaaagcacaaaatttgtagcatgtatgacaacttaagggggaaattgcctggacaagagaggcctagtgatgaccactttgtacagatcatgtgtatccgaaaagggaagagaatggttgcccgtattcttcctttcctctccacagagcaagcagctgacattctcatgacaacagccaggaacctccctttccttatcaagaaggatgcacaagatgaggtgctgccatgcttactgagtcccttctctctccttctctatcatcttccatcagtgagtatcaccagccttttgcgacagctaatgaacctacctagttcagaccctgctacagaatcaacacaaaataatcagtggacggaggtgatgttcatggcaacacgagaacttctgcggattccccaagcagccctggccaagccaatctctatacctacaaacctagtgtccctcttttctcgctatgttgaccggcagaaactgaacttgctggagacaaaactgcagctagttcaggggatacgataaaagatctccaaatgtgtcctgtacctccttttggctgccacctgcactgctgccatcaccaatggagtgtttttaatgagggaaggaaggtagctttttccccaaagcaaagtcttgtgggatcgattcctgtttacaggggttgtctctctaaatgtcagatatttccccactgctctatgaaatttggctgggtgatacttctgctggtttctttaccttctgtgttacagttctgcatgtcctacttttactcagttctgttttgcattttctttgccctagagacacaagtgtaatctctccctttatccctccactactccacctcagagtagattgtagcctgccaaaggattccttccctcatcctattgaagttgttttttcattgccccatattaatatgactatagaagagccaattaagtagaaatcaagatatacacacacacatagatacacacacacacaccccatacatgtatttatgtggtcttcagagggtccttaaagaatgaattttagattgaaaaatatttagttgtctcattacctcttctaaacacaaaccagctgatgtattttaatctgtttctgttctatcttgtaattaatttggtgggttctacttgttttaacataaataaagagtatgcagcacgtttaat

SEQ ID NO: 3067 - DNA, 1709 bp, Homo sapiens
ggtacctcgtggagaagacgggggaggggagcagcgagatttccttgcggagcaatattcctagggtacagacctcgtagcccgggcccgcgactccgccccgggagcgggcaggggcggggcgagcgctccagctggcgggaaggaggaagggccgggcgcggcgcagaggcgggcgcctaccagccggcagctccggagctgcccgcgccatgtccgcgcacaatcggggcaccgagctcgaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagccgccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgtggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcagatttaccatcatgtgactggaagatatgcagcttatcatgatcttccaatgtcttaaatcagtcaccagttccagaaaagttctttacgacaatgtttaaaaattatttttctacgtaattgctaaaattatttaattaaaaaattgggcagtaggtaactggcattcctctctttaaaatttctaccgaacttaatggaatggaaaaagcaaactcatccacatgtggtactcatttcaggcacatctgaaatgatcttaattactagaagatctgcactattaactttgtgaagagtttctcctaaaaactttaagtaaaatgttaatggtagctttgataacatcaaattctaagggagaaaaaaacaatattaaaccgcccaagcagtgtgccctagcagaggaaaatgcaacatctcgcaagcgctgctgtaacgacttcaggagtcactgattcagcactaatttcctgctgtgaaaactcatctttcatttttgccgtggataggcgcttttattaattgttgtcctaatgaaatttctgacattgtcatatacaacgatgaatatcattaaaatttttaaaataataaa

SEQ ID NO: 3068 - DNA, 3010 bp, Homo sapiens
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtgtggatggccagggtacctggggactcaggctgctgccagttctgctcaccaccatccgtgcttggcacagaagtagctgcatagaaagagcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatgtagagaaaaaaaaaacctgctctatatctgaaagagctcttgggaagacagagaaacataaagaggaaattatagcacagtgtggtgggtgttacgggaagtccaaccccagcattatgggagttcaggggaaggggcatagcccagcctggaaggagaggatgagtgggggatggctttctgaaaagggtagtctaaaggatgcctatagtcaatagggaaaagaggggaagaagcatcttaagaagaggaaacagcagagaactggctggatgacctgtgactctggagcactgggttgtctccattgtccttatgggcagatgtgtgccatccccagccgacaccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgacctttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagatgtaaaatacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattaaagattgaattgctttccctgggagtgtgcagtatctcattaaaatgttgtatattcaaaaaaatacagacacacacaagtgcctatataatgataaaacatatgcaaagcacccaaacctgtgattccagaaaggtagatcctatttttctgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 3069 - DNA, 5125 bp, Homo sapiens
atcgggccgccggcgtccgggctccagaggccgcctggctgggcgcccggtgccttttgtctggcgcagggccggcgtttgcatcacatttcggatacctccctctctttttcgcctctccttctgcctcccgctcacatcgcctccccactcccgccaccgtcccccgccggactgctagcctcctagaccgaagcccgaggacgtctctgcccgagcgatgtcccctctccagaaagttgccgccgccgccgccgccgccgccactgccgccgctgggcggtgaaacaaagtctggcggggccgcctcccggtgcaggagcgcaccggtgcctagcggctggactccgctgccgggcgtcccgctttcccccggggagccctaaacgctccaggccatggccgagggcgcggccggcagggaggatccggcgccgcccgacgcggcggggggcgaagacgacccccgagtgggcccggatgccgccggggactgcgtgacggcggcctctgggggccggatgagggaccgtcgcagcggggtcgcactgccaggcgccgcggggaccccagcggacagcgaggcgggcctcctggaggcagcacgggcgaccccccggcgcagcagcatcatcaaggatccttcaaaccaaaaatgtggtggaagaaagaaaaccgtgtctttcagcagcatgccatcggaaaagaaaattagcagtgcaaatgactgcatcagcttcatgcaagctggctgtgagttgaagaaagtccggccaaattctcgcatttacaaccgttttttcactctggacacagaccttcaagctcttcgctgggaaccttcaaagaaagacctcgagaaagccaagcttgatatttctgccataaaagagatcagactggggaaaaacacggaaacatttagaaacaatggccttgctgaccagatctgtgaggactgtgccttttccatactccacggggaaaactatgagtctctggacctagttgccaattcagcagatgtggcaaacatctgggtgtctgggttacggtacctggtttctcgaagtaagcagcctcttgattttatggagggcaaccagaacacaccacggttcatgtggttgaaaacagtgtttgaagcagcagatgttgatgggaatgggattatgttggaagacacctctgtagagttaataaaacaactcaaccctactctgaaggaagccaagatcaggttaaagtttaaagaaatccagaagagcaaggaaaaactaaccacccgcgtgaccgaagaggaattttgtgaagctttttgtgaactttgcaccaggccagaagtgtatttcttacttgtacagatatctaaaaacaaagaatatttggatgccaatgatctcatgctctttttagaagctgagcaaggagtcacccatatcaccgaggatatatgcttagacatcataaggagatacgaactttctgaagagggacgtcaaaaagggtttcttgcaattgatggctttacccagtatttattgtcatcagaatgtgacatttttgatcctgagcaaaagaaggttgcccaagatatgacccagccattatctcactactatatcaatgcctctcataacacctatctaatagaagaccagttcagggggccagctgacatcaatgggtacattagagctttgaaaatgggctgtcgaagcgttgaactcgatgtaagtgatggttcagataatgaaccaatcctttgtaatcgaaataacatgacaacccatgtttcctttcgaagtgtcatagaggtaataaataaatttgcctttgttgcttctgaatacccactcattctttgcttgggaaatcactgctccttgccgcagcagaaggtaatggctcaacagatgaaaaaggtctttggcaataaactctatactgaagcacctttgccctcagaatcctacctcccatcaccagaaaaattaaaaagaatgatcattgtgaaaggaaagaagttgccttctgatccagatgtgttagaaggagaagtaacagatgaagatgaagaagctgaaatgtctcgaaggatgtcggtagattacaatggtgagcagaagcaaatccgactctgtagggagctctctgatttggtgtctatttgtaaatctgttcaatacagggattttgaactatctatgaaaagccaaaactattgggaaatgtgttcatttagtgaaacagaggccagccgcattgcaaatgagtacccagaggattttgttaattataataagaagttcttatcaagaatctatccaagtgccatgaggatcgattccagtaacttgaatccacaggacttttggaattgtggctgtcagattgtagcaatgaattttcagactccgggtccaatgatggaccttcacacgggctggtttcttcaaaacgggggatgtggttatgttctaaggccgtctataatgcgagatgaagtttcttacttcagcgcaaatacaaagggcattctacctggggtgtctcctctagctcttcatatcaagatcatcagtggtcagaatttcccaaagcccaagggagcttgtgccaaaggggatgtcatagatccctatgtttgtatagagatacacggaattccagcggattgttcggaacaaagaactaaaactgtacagcaaaacagtgataatcctatttttgatgaaacttttgagttccaagtaaacctacctgagctggccatgatccgttttgttgttctggatgatgactacattggggatgagtttatagggcaatatacgataccatttgaatgtttgcagcctggatatcggcatgttcccctgcgttcttttgtgggtgacatcatggagcacgtaaccctttttgtccacatagcaataactaatcgaagtggaggaggaaaggcacagaagcgcagtctttcagtgagaatggggaagaaagttcgggaatataccatgctcaggaatatcggtcttaaaaccattgatgacatctttaaaatagcggttcatccattacgagaagccatagatatgagagaaaatatgcagaatgcaatcgtgtctattaaggaactatgtggactccctccaattgccagtctgaagcagtgcctgttaactctgtcatctcggctcatcaccagtgacaatactccttcagtctcacttgtgatgaaagacagctttccttacctggagcctctgggtgcaattccagatgtgcagaaaaagatgctgactgcttatgatctgatgattcaagagagccggtttctcatagaaatggcggacacagtccaggaaaagattgtacagtgtcagaaagcagggatggagttccatgaagaacttcataatttgggggcaaaagaaggcttgaagggaagaaaactcaacaaagcaactgagagctttgcttggaacattacagtattgaagggccaaggagatctgttgaagaatgccaagaatgaagctatagaaaacatgaagcagatccagctggcatgcctgtcctgtggactgagtaaagcccccagcagcagtgctgaggccaagagcaagcgcagcctggaagccatagaggagaaggaaagtagtgaggagaatgggaagctgtgactctgggcattatcgacacgttcacccatcttatcaaggactctggtttctcattcttgttttctttctttaaatgttttataagttcacaaaatggtgccctatatggggtattggacatagatattttcacaatgtcagtatttcagtgtagttaatttatctaaattaaagcctttagtatcagtgttttaaattctgagacatgtgtcaacacccctgtgtggatgcctgtggaagagtgtgtgtgtgtgtgtgtgtgtgtgtgtgtggcagagagagagaaagagagagagagagagaaattctgttaaaatctattctgtgttgcattattcatttagtgagttattccttgatcattttgggacaattgttttaatctgaaattctaaagagcacttactgtaacctgttgctgtgtttaatttgacttctctgcctttgacatttaatttagtgatcttagcatagcttattattgaaggaagccaaatttatcaaagcatagatgttttggtagattaaatatagattagaaaaattcctaagaatcagagtagaaataaaagtgaatgaaagattaaacagatgatgagaatttctaaaaagattagcaaggtcatttcttcagtcagaaaactttaaaaaatatttattaaataaaatcaatttttaggaagttttctgtagtcatttactaaacatatgatttcactagaaaagctgatcataagtgaatttatacctacctgtgtggtactctgaaacacactgaaagctctgttgcaattaggattttgatgtgacaataatattgttgtataatttcgagatttgtaggaaggtctcattcttccaagctgagagtctagcactcattttctataacagatatggcagcttagaggtgttggctttgtttggatgtaatttagggtactaaatttaaatttaaagatattgttcaaacaatatcatatcatcacattgagctgatataaattctgtgggtccgataatatctttgtgataatttaagagctaaccagttaccacacatctatgatataaccctaacacacacagaaaagcatacatgcaaaaagaaatgactaattagggtacatttataattgcatctaggtaatttttaccctaatgtcttcataaagtacttgagtgtaatgtttgttacctccaacagaactaaatgttctatggttatgaaagaatatatttatttaaagcattgcttttattttgaaaagcttcttaattaatttgattaacaaatatgctaatttggggaaacctagagaagataattgttgaaattttgcaaatataaacatctcctatagcttctgtgttatttctgacttcttaacactattatgtttatgttgcacattactgaaagagtaaagatatgaaaa

SEQ ID NO: 3070 - DNA, 876 bp, Homo sapiens
aaagagcccgctccgccgagcgccgggcgacggcaggaagcccctccgcttggccagaatggagcagccgaagggagttgattggacagtcatcatcctgacctgccagtacaaggacagtgtccaggtctttcagagagaactggaagtgcggcagaagcgggagcagatccctgctgggacgctgttactggccgtggaggacccagagaagcgtgtgggcagcggaggagccaccctcaacgccctgctggtggctgctgaacacctgagtgcccgggcaggcttcactggtcgagacttcccctttgatgactgtggcagggctttcacctgcctccccgtggagaaccccgaggcccccgtggaagccttggtctgcaacctggactgcctgctggacatcatgacctatcggctgggcccgggctccccgccaggcgtgtgggtctgcagcaccgacatgctgctgtctgttcctgcaaatcctggtgagcctgagactacctgggactgccttccttcgtcacagccacagcaagaagccagctctgcccttcttgcccaccctgcctctgggcctgccccgctgccctattagacgggaagctggagggtgtggagaatgaagcctggtggaggcagggcttctcctgctgtgcctcagtctgtctgtctataggatggacagaagcagccctgccccttctgtcccacagggctctgcggaagaactttgggagaggagggttgtcattctcccaggcgaatgtccatttggcttggaaaccgtatttcccttttagaggtgcccaggtgccgcagccctgggctcttgcttccacctggtggggaaatccgtgccttgggtggagg

SEQ ID NO: 3071 - DNA, 2911 bp, Homo sapiens
cccgcccgcgtggtcgtcgccaccgcagccgcccgagaggagctgggggaggacggtggcccgcgaggctcgtcgcagacaacgcggcggcgatgtccgcgagccagagcacaaagttatcattgttgggctggataatgcagggaaaactaccattctttaccaattttctatgaatgaagttgtacatacatctcctacaataggaagtaatgtagaagagatagtgattaataatacacgtttcctaatgtgggatattggtggccaagaatctcttcgttcttcctggaacacttactatactaacacagagtttgtaatagttgttgtggacagtacagacagagagaggatttctgtaactagagaagaactctataaaatgttagcgcatgaggacctaagaaaagctggattgctgatttttgctaataaacaagatgttaaagaatgcatgactgtagcagaaatctcccagtttttgaagctaacttctattaaagatcaccagtggcatatccaggcatgctgtgctctaactggcgagggattgtgccaaggacttgaatggatgatgtcacgacttaagattagatgatctctactgacctcttctcatagattttgtataaatgaagtgctggactttacctgaaagctgcaaaaattaatggtttagatatatttataataaactgatttaaactttttctataagaagaaaaattaagaccacttatttgaaaacaaagatgaagtctcaccttccagtttgctttctcattagttttttccaaagtaagttattgaagctgtgattgacatttttctcataatgaatcctctcaggacattgtgtagcctatggtaagtacaaagggagaggaagacattttgaattttaagagctttattatcagtttaaccctccctagttgaatgttattttcttcttgttccattaagtcagaatacaaatcagcacagatattcgaatgtttccaatattttaaaatgtaatgttacttatgaaaagtattttgcttaaggttgtgtgtgtattgtgtatatacctcaagttcaagttaatggcattgatttatgttccagacaaaaataacacaaataataatatccttcgttataaccacaatgagataagtattggcattagtgttcagtgccattttatactttctctctgtgttctctgtattgtactaaccaacctcccaaatcgctgagctgcttgtttaaaaaaaaaaaaaaggaaaaggaaaaagcatgacattgtgtatcgattttttgttgttgaccaaaatcacacacatggaaacatgtaattcaacagagtgggaaagctagcagattcttggcttagtattactaataggcaggattgtacaatgagcaactatcagattattcctttcagtggttcttatggcatctaaattactgaataaattattaatccattaatcagtgaatcaaattatgattacaattatcaaatgaatgctcagcattaattgaaaactgttttgtgaaacatgtctacccagaaaagtagcattctataaatactattaaacaacttagctatattatttttaagtattaaattatatgtcaagcagttaaagtgaatttcagagtaaaagtaaggcatgtttctgagcaacattgataatttcttaatttgcaaatttcttcttattttggtacttggaatatagtgtgagattttttatttctaaattttgttgtatcttctattacataaatgcattgacaattataaaatgcaagtgttttttgaatgattttaagaatttggcttaaaaattgattgatacaacgtattatttgtactaagaagtaacttgacccaaaacaccttttatgtttgcttagggtatattttttcagtgtctgaaagtcaaaggtattcctgtcacaactgtaaacaaacttatcctaaatgtgttaaaacatattcttgggtactctatttatgtatctttcatgccttgaaaatctgaaggttaatccaaactcacatgttttagcatatttgagaaaaaaaaactaccttcaatatcagccttttaaatttcatgaagattttggtgaggaataatagtatatagtttaagtattgacaaaactttgaaagtttctttctttaaaatgggaaatactcaatatctaaatccaggtcaggcatgggatatcagtatttaacattggatgttttatgttttatatttataatgttcaaaatgcaagcataacatttaatatttgtccacatggttttacaaaagtaaatcttaaattactaagcttttcccatatgttctcgtactttctcaaatccctataaagaattacttgttatctattaaaaatctcctttacccaaatctgtattatggtttcgccagacaaatattatgtgatgtagcccagaaaatccacaccttttgtcctttttatgttttaatttgaataatcatgtgcttagtcccttggattactgccacatcagtttaacacgatatcagcacattcccttgtcatcatcaaggtgttggctcagatttattcttaattggatgtttaaagcatgtactaccttgttacagttggtttagtgtagtggattattgacatgacatcatgagaagatgtgtaattttataccacatttataaaacatgattttgttttctacccttcaaggtaaacattaaaaataaggtggtacttgtgtacttgtacataaaaccaaaattatagttgggaaaaaaataaatttatatatgaaaatgtcaaaatcattttaaaagtattattttcaaataaaatggagaagctggtgaaaagtcatattggcaatttt

SEQ ID NO: 3072 - DNA, 2101 bp, Homo sapiens
cctgggcatgcgcgagcgcgtcccgggcccggcgagtcgagggttcaggtggtgcgccgtggcgccgcctgcgaccggcagctcgttcgccgcactttggaggcttcggctgcccctccgacccacgtagggcccggacccgggcctccttgtgaacagcgtgccggcttcgccccacgggttcaccggctggctgggcttcaagcgccgaggccgccgcagtgaccccgcccccgggccgaggatgtgaggcgggccgggcgtccccacaccgggcccgggcgccgggagtgggcgtctgggcagcgccaggcgatggccctgctgctggtgctcctcgcctcttggggcctggggcagtgagggggccggcgggcgtgggccgagtggccgcgggcgccatggagggggtgctgtacaagtggaccaactatctgagcggttggcagcctcgatggttccttctctgtgggggaatattgtcctattatgattctcctgaagatgcctggaaaggttgcaaagggagcatacaaatggcagtctgtgaaattcaagttcattctgtagataatacacgcatggacctgataatccctggggaacagtatttctacctgaaggccagaagtgtggctgaaagacagcggtggctggtggccctgggatcagccaaggcttgcctgactgacagtaggacccagaaggagaaaggcaatttgctgaaaacactgaaaacttgaaaaccaaaatgtcagaactaagactctactgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagatcgcaaatgcagccttcacctctgagctgctctaccgcactccaccaggatcacctcagctggccatgctcaagtccagcaagatgaaacatcctattataccaattcataattcattggaaaggcaaatggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataacagtccaaggtgaaataaggaaggaagatggaatggaaaacctgaaaaatcatgacaataacttgactcagtctggatcagactcaagttgctctccggaatgcctctgggaggaaggcaaagaagttatcccaactttctttagtaccatgaacacaagctttagtgacattgaacttctggaagacagtggcattcccacagaagcattcttggcatcatgttatgctgtggttccagtattagacaaacttggccctacagtgtttgctcctgttaagatggatcttgttggaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggagaaggatatccagacagccctaaataatgcatatggtaaaacattgcggcaacaccatggctgggtagttcgaggggtttttgcgggacacacaaatgtctgatggtggcccaggagggctgtcactcagaatcaggcgggtgcagagtggcctgcaggacatgatgacccagcatgagacaggatgcatcacatctgggtgacgcctctctccaggggatcagcctggactaaatgcctctcctgggccaggatgcccagcaagccccgagatgcctcctggagagaaggaagtatgtgagagtatcctgagttaagtgagatctaaaatgcctgagaaaaccctgaaatgactgagtctatctggaacttatttgattgtttttctgccatcagatagaatgaggtctcaaaagagaaa

SEQ ID NO: 3073 - DNA, 1462 bp, Homo sapiens
gcgagccgggcaactgccctccttccgcgccggcggagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagaagtaaaataagtgaacttacaactgaagttaataaacttcagaagggaatagaaatgtacaatcaagagaattcagtatatttgtcatatgaaaagagggctgagactttagctgttgagataaaagagcttcaaggacaactagcagactacaacatgttggtagataaacttaataccaacactgaaatggaagaagtaatgaatgattacaatatgcttaaagctcaaaatgatcgagaaacacaaagtttggatgtcatatttactgaaagacaagcgaaagaaaaacaaatcagaagtgtcgaagaagaaattgaacaggaaaaacaagcaacagatgacattatcaaaaatatgtcttttgaaaaccaagtcaagtacctagagatgaaaaccacaaatgagaaactgttacaggaattagatacacttcaacaacaattggattcacagaacatgaaaaaagagagcctggaagcagaaatagctcactcccaggtgaaacaggaggcggtattgctgcatgaaaaactttatgagttggagtcccatcgagatcaaatgattgcagaagacaaaagcataggatctccaatggaagagagagagaaattacttaagcagattaaagatgataatcaggaaatagccagcatggaaagacagttaacagatacaaaagaaaagataaatcagtttattgaagaaattagacaacttgacatggatttagaggaacaccaagatcctaccaactatggatggaaaatacttgaaaaaaatacaggaagtttcaaaaagcaagtttgaacctgccatgtgctaagcactatgctgaatccatttgaactgaagaataccctgctatagcctcccattgtttcacagatcttcagtctctctctagcacccactgtttgagcagtgttcatctggcattttattcattggctacttgtgttcactctttgcttctgtgaaaaaaaaaagactcctaaaaatcaattatatggtgaaagaaatcccttacagactaagagagagcgtaaagtgctgtctctcaacaagaaaataaaattcttagatcttttgaaaa

SEQ ID NO: 3074 - DNA, 506 bp, Homo sapiens
ttcgtgacccggagctgtgcgaggagagtaccgaggagggggactcaagagtagccttcctcgaggacctgcctttcccatttgctgcctgaagttaatgtttcttgctggccaaatcagggacatgccggcattagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaag

SEQ ID NO: 3075 - DNA, 539 bp, Homo sapiens
cttttcaagcaaagccccatctcgccgtgctcacaggactactgtcataggaacatggatgaaacttccaattgaagacactgagctgaaccattccgcccgcccgcccgcccgagggcactccagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgggctgtgcggagacacctgttcccccagcactcagcccctggccga

SEQ ID NO: 3076 - DNA, 644 bp, Homo sapiens
agtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccgggctgtgtttgtagacttggaacccacagtcattgattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaa

SEQ ID NO: 3077 - DNA, 1476 bp, Homo sapiens; identical to SEQ ID NO: 1945

SEQ ID NO: 3078 - DNA, 3583 bp, Homo sapiens
attcccctccacttcttgcctgagccgcctgctcctcttggaaacacgttgagcctccccgctggagagggagccagaacagggaagaacggattcacacaggatggcttgcagaagacgctatttcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccgggaagcgagggcgtcgcagcagtgcgggatcgctagagagcaatgtggaagggtccatcattagcagtcctcacatgcgccggagagctacatcaacacgagagtgtccatctcgcccacaccagactatgcccaactcatcttccctcctgggctccttattcgggagcaagagagggaagccccctccccaggcccacctgccctcagccccagccctggccacccccccacccaccggtggtcctgcctcacttgcagcactctgtggctggccaccacctggggcccccagaggggctgccgcaggccgccatgcacgggcatcacacccagtactgccacatgcagaaccctcccccgtaccaccatcaccaccaccaccacccaccccagcacatccagcacgcacaccagtaccaccacggcccccatgggggccacccagcctacggggcccatgcccacggccacccgccgctgccctcggcccacgtggggcacacagtgcaccaccatgggcagccccctgccccgccgccccccaccagcagcaaggccaaacccagcggcatcagcacaattgtgtagacagcctgggtaggggtcccaggctccctgaaacacctgcacaccacacagggcacgcccgggggtcgccagccgcacaccaaacccggggcacttctgttgccatctctcccctctgcccctcacggcccaac

SEQ ID NO: 3079 - DNA, 550 bp, Homo sapiens
gtgcgtttagggcgaagacggagttgtaaacttcttaaaattcctctctcgacacttcgggaccggaagagtccttgaaccaaaatagctcggcgggcacttccggggccggcgcccagagttccgggagggtgcaggcaggagagggaaaggcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggatgcgtattggatagcaatgaatagttctctgaaatgtaaaaccctcagcgacatctttctgcttttcaagagttccgatttcatcactcgtgacttcactcagccgtttattcattgtactgatgattctccagat

SEQ ID NO: 3080 - DNA, 480 bp, Homo sapiens
gggatgctggggcgcgagcgggactgttgactaagcttcgttactgggccctggaagcgaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaag

SEQ ID NO: 3081 - DNA, 8073 bp, Homo sapiens
cagcgcgcgctcctgcagccccggcggagtcccggcggggagcgcccgcgtaggcaggcacccggggcagccctccgtcctcgccgcgcggcctgagaacccctgggccctgggcgagggggctgggctgtgcagcccccgaggctaactgggcgggatcgcagctgcaggggttgtgcgagcagccacggcggcacctgtgccctgcgggcacccaccctgcccctgccgaggcaggcgcccaccgccggcggtgatgcggctgtgaagccctagtcgattaacgtgacagtgtcaggtggacccacagccatcccacctccccctctggggagtgctgagagtgaggcagcatggaggagaggaagcatgagaccatgaacccagctcatgtcctctttgaccggtttgtccaggccaccacctgcaagggaaccctcaaggctttccaggagctctgtgaccacctggaactaaagccaaaggactaccgctccttctatcacaagctcaagtccaagcttaactactggaaagccaaagccctctgggcaaaattggacaaacggggcagtcacaaagactacaaaaagggaaaagcgtgcactaacaccaagtgtctcatcattggggctggcccctgtggtctccgtacagccatcgacttatccttactgggggccaaggtggttgttattgagaaacgagatgccttctcccgcaacaacgtcttgcatctctggccattcaccatacatgatctacgaggtctgggtgccaagaagttctatggcaagttctgtgctggagccatcgaccatatcagtatccgtcagctccaactaatacttttgaaagtagccttgatcctaggcattgaaatccacgtcaatgtggaattccaaggacttatacagcctcctgaggaccaagagaatgaacggataggctggcgggcactggtgcaccccaagactcatcctgtgtcagagtatgaatttgaagtgatcatcggtggggatggtcggaggaacaccttggaagggtttcgtcggaaagaattccgtggcaaactggccatcgccatcacggcaaattttatcaaccgaaatacaacagcagaagctaaagtggaagagatcagtggtgtggcttttatattcaaccaaaaatttttccaggaactgagggaagccacaggtattgacttggagaacatcgtttactacaaagatgacacacactatttcgttatgacagccaaaaagcagagtttgctggacaaaggagtgatactacatgactacgccgacacagagctcctgctttcccgagaaaacgtggaccaggaggctctgctcagctatgccagggaggcggcagacttctctacccagcagcagctgccgtctctggattttgccatcaatcactatgggcagcccgatgtggccatgtttgacttcacttgtatgtatgcctccgagaacgccgccttggtgcgggagcagaacggacaccagttactagtggctctggtcggggacagcctcctagagcctttctggccaatgggaacaggaatagcccggggctttctagctgctatggactctgcctggatggtccgaagttggtctctaggaacgagccctttggaagtgctggcagagagggaaagtatttacaggttgctgcctcagaccacccctgagaatgtgagtaagaacttcagccagtacagtatcgaccctgtcactcggtatcccaatatcaacgtcaacttcctccggccaagccaggtgcgccatttatatgatactggcgaaacaaaagatattcacctggaaatggagagcctggtgaattcccgaaccacccccaaattgactcgcaatgagtctgtagctcgttcaagcaaactgctgggttggtgccagaggcagacagatggctatgcaggggtaaacgtgacagatctcaccatgtcctggaaaagtggcttggccctttgtgcaattatccatagataccgccctgacctgatagattttgattctttggatgagcaaaatgtggagaagaataaccaactggcctttgacattgctgagaaggaattgggcatttctcccatcatgacaggcaaagaaatggcctccgtgggggagcctgataagctgtccatggtgatgtacctgactcagttctacgagatgtttaaggactccctcccctctagcgacaccttggacctaaatgccgaggagaaagcagtcctgatagccagcaccagatcccctatctccttcctaagcaaacttggccagaccatctctcggaagcgttctcccaaggataaaaaggaaaaggacttggatggtgctgggaagaggagaaagaccagtcaatcagaggaggaggaagctcctcggggccacagaggagaaagaccgaccctggtgagcactctgacagacaggaggatggacgttgccgttgggaaccagaacaaagtgaagtacatggcgacccagctgctggccaaatttgaagagaatgcgcccgcacagtccatcggcatacggagacagcaacgggaaaaggagtgttctcggacctgccccaaaaaagtgatcaccctgtctcctccccctactccacctccctgtcgggcacatggcggccagcagacatacagggatcttgatgctgacaaccgtggcaagcagagcccccaccatgagaggccagagcctgaacctcctcgtcgattttttgtcgaccagtgggagctttctcttagtctccgctcctctgcccgccccgcctctccctcctccgactccctccgacagaagtatataaagatgtacacgggcggagtgagctcattggctgagcagatagccaatcagcttcaaaggaaagaacaacccaaagcccttctagacaagaaggaactgggctccatgaagaaggagttcccgcagaacctgggaggcagcgacacatgctacttctgccagaagcgggtctacgtgatggagaggctgagtgccgagggcaagttcttccaccggagctgcttcaagtgcgagtactgcgccaccaccctgcgcctctcggcctacgcctacgacatcgaggatggtaaattctactgtaagccacactactgctatcgactctctggctacgcacaaaggaagagaccggcagtggctcccctgtctggaaaggaggccaaaggacccctgcaggatggcgccaccacagatgcaaacggacgggccaacgccgtggccagctccactgagagaaccccaggtagcctcacttccttgtttggctgggtggcgcgtcactccctcggcctctgtgacaaggccaagggcatgagccagcacctccaaagcaacatttcttcattcgggcaacaagtggcccaaaaccctctggactcctttttcatgtgccagctgcttgcgttcggagtcccctttctctatggcctgtcggaggtgctggtgcaaatcagaggggagttccactggcaggctgtggcccagtgatggggccgtccggtgggcggcagagccgtgaagtgctgtccctcagccccgtcccgcaccatcacacctgagggcggcccaggtcctgtgtaggtagacaggagctcgcaggcgctcagacactgctcccatcacccgccctggtgaggccaaggccactcggccttcatgcagtttgcttccaagctcctctgacggcctggagctgtgttgattaagccccgtggtcttgttttgggttcaccttcacttaagattctgcgtcctgttccctgtcactgtgtgtggatgagctgtggctgctctcctgtctgccctgcaccgtgatgggacatgccctgtcctgaccccttggccactgggcttgtcatgaggtccaagccctcacctgtcccactttcatgaccacttccttgtgttgggaggtgaacagtaccatctctacctctacaaacacatttattcttgtcatagcatgacaggactcgcagggtttgtgggtaccaggcctgttgggaagaattatgtagattttccttaaaatggcctctctcagcaacttgtaaaacttgcctgtgagatgcgtccagagctccacaaactgctgggtgttctgaatgtcccacatacagctccaggtggttcacggcccagggtcactgtggcaagagggggccagcagggctgtgtttctgtctgtcacactttcctcttgttcaaaacacatgtatctcaagcagctatatacaaaactcataaaaattaaagatggtcagccagtgccaggaaatgtggaggaggagttggtcatagaatttccatggtgggacaagagaattacccatttggccttcaacgagaggttcccagagttgcatcctttcccttccctaacagctggttcatgtaggccttgtggtgctcattctgggagagggaagatgcgcccagaggctaggcggtgtgccctgggagccatgagaacccagccaagccaggtgaacgcagcttctgctactgcacgtgcccttattatcatctgagcaagttttttaagtaccctgcaggtgggaccaacattttatagccatgtttcaaccattaatgacttttaaaccttctacaatcttgaagatctttataatccatctttctcgtgaagtacccacaggcctttgcagctgacactctcagagcatgggcagaatcactggtagagaaaaataaccaaaggggtctagacagagactttggctttatgctatagaatgtacattcagttggagagagcaccaccttattagtctgggccctatttcatcagagatggattttgtgaggaacctgactactcagtagaacaactcaaaagaaactaaactttccatttcggtttggagtacagaacattttttaaaaagaattaaacacagtgaagtttaggttattcctgaatgacgccaggtttgctgactttcccatctggtcgaggttgccattcttgccatctaattgaaagtataatgggtttcaggtttttaggagttctaaagaattacgctttccatagagaataagaggaagaatgttctacatagtggggagagaggatgagggttggcagtgtggttaaagagcaaaaccaccaagaaagagtcagagccctgaggacgtctctgtccgcgtggttcttgattctgagccagaaggtgacttggtatagcacgggagttcaaaatgtggtgtcccaaaggaatcacagtgtggacctttacagttaatgacaggcactgtcccccagcttgggtggcaaaggccagtgagctcagggctgaggggcttaccctccggcagctcagagtccagaacatcttagtccggcagctcagaatcagggcaccttgcctcccggtgagctcactctgctgctagccttggtagaaaaggaacaggattatgggcagtattttatggctggcatgaaatagatacccttttctcctttgatagagatttccttctttaaatatgaaactgaagctttgaggacttaactagacttccttttgaaaagtttcagaaaagctcaggtgtggccaggcacgatggctcatgcctgtaatcccagcactttgggaggccgaggcgggcagatcacgaggtcaggagatcgagaccatcctggctaacacagtgaaaccccgtctctactaaaaatacaaaaaaattagccgggtgtggtgtggtggcggatgcctgtagtcccagctactcgggaggctgaggcaggagaatggcgtgaacccaggaggcagaggttgcagtaagtcgagatcacaccactgcactccagcctgatgacagagcaagactccatctaaaaaaaaaaaagaagaaaagggaaagctcaggtgtttcagggtcccagaatgtatgttgtagagaacagtcattagctcaggcccatggtaaccgcctctactgtgcactcgaccagtagaggcgatgatgacggcacttgattctcttgtgtgtaactcagccatcctccctagacccacgtcccaggaggcagggctggtaaagctatgactgggcagtgtttgacccagctgtgcttttactctgtgcctcctctttatattgtggcatttctctcttctcctttatgttctttttctttttatgccaaaattcttgctgttgccaaaacaaaaacaaaaaaacacacccacacccaattacaacctgcagttcaaagaaccactctaggtcggctttaaagtattgtctttctctggtaaccaaatctgtacctgctgcctaatttagtgtttgggggcattgtttacagtatttctgtttgtaatgtgcttttaatatagaaatcctcttttttgttcttaaatctatgaatgctgtgtttccaagcttatacttactactgcgtgttagtggtcctggcacagattttcttaccctggccttgtactgtccaccatgactttagaaaaagcttgaacaataggcagagaaaggaaatccccaaaagggattattttccccttggacatgagaagtttagttacaggtttcttgaattcgtttttgtccagaggaatcctctttttatctgatacggttgatgaccaaaaatgaagtagggaagccgaaggcatagccggaaaggaacagaagagctttttccccgagtgctcatcaccgggttcattaccggccagagatggacggggagaagcacgttagtttcctgtcatcttatggaaaagatgatctgaagttaaaaaatgaaggtcacaagtggcagttgcctgacccctgtccccagacattccttgcccgataaccatgaggttccatagttcggatcctgaatgggcctttaggaaatgcaggcctttcccacaccagctagaagggtagccaggcagtagaatttcattcaaccctagggttcccacctgacagagggaagttcggaagtcttactgcttcccacgtccccttcccttctaggcatttatggaaagctttttagtggagcaagagaattctacaatccagcttacctcccaccttaccccaagagccatagctgacggtgatgtgtgaatgtttatatataggtacacgtttgtatgtatatagatctaattgcacatatatgggtagatatttatttatatgttgcaccctaaattatagtaattataataattgtgaagctgtttctaaagctgcttgttcctggttctgagaaccacgggagcctcacactggggagccgtactccaggtcagggctttggggatgcacagcagcgtacgggcagcacgcctgtaaggaggtgagtgggtgggtgtctcagaaaatgggcagcacacccccaagaaagggccccaagagcagactaggaacgcagggggctgctgctgccaggacaccacggagagccgggcacccgcctcacatgtctcctgtctggctccactgagttagccgtttgagcccactcctatcttttggtggttagtgcatcttcagctcttttctgcaagacactggaacattcctaggctgtcccaaaaggagttccaccatagcctttaaggtccgagcagggcaccaaggggttcacttttctcccgagccattcagcttggggtgcctgcgggaggggcggacagccagccggcttcccggcggcggtacgagagcccaacaggagaggattagctgtgccaaggaacacgccactgctgcctgtctactgcccgccttctctccacttccatttttgcctttgtttttaacttgtgctcttgtgagttcttggtgtgtttctttgtgagtttttatttaattgtgtaactttgtttttgccgttgactgtgaaaccaagttgtcgtgcttttaattttttttttaacaaatgttacattcttatttaagagaataaattccaaacaatcttcgg

SEQ ID NO: 3082 - DNA, 1538 bp, Homo sapiens
aagcgctgaggcggtggggcccacagccatggcggagcctgtgcaggaggagctctcggtcctggccgcgattttctgcaggccccacgagtgggaggtgctgagccgctcaggaccagaaaataacacagagaaaaatgaaaattggtaaggactgacatggctggctcagtagcttttcaagactttccccctggactaccaacatgtttctttcctgtggttccctgcaccagagaggacccgagacagatgggaccgtgttcagaattcacacaaaagctgaaggatttatggatgtggatatacctctggaattggtgttccatttgccagtcaattatccttcatgtctacctggtatctcgattaactctgaacagttgaccagggcccagtgtgtgactgtgaaagagaatttacttgagcaagcagagagccttttgtcggagcctatggttcatgagctggttctctggattcagcagaatctcaggcatatcctcagccaaccagaaactggcagtggcagtgaaaagtgtactttttcaacaagcacgaccatggatgatggattgtggataactcttttgcatttagatcacatgagagcaaagactaaatatgtcaaaattgtggagaagtgggcttcagatttaaggctgacaggaagactgatgttcatgggtaaaataatactgattttactacagggagacagaaacaacctcaaggtgccaaaaagttaaatgttgagtatgaatctggctattttctgctttaaatggtgtgtctttaagtgtgttttataacaatgggatagattaattattaagatgtttctgctttcattattacaatcttaatggatcttccttttctttttaaagaatgtctgactgctaattacaagtacaaacttgcaaagcttgaagaataagattgcattttaaaaatcatgtcacttaataaagtgacaggttatttaaaagctctgtggcacatgagtgtttgtttctgtaattagctatgagcttgaattttataaatgtgcactaaaagtttgtgcatattaatatttcttcccatagttaggcacagcaaggtgtgtatttgtggatagtctgcaagatttgtaactttctggctgttaaaaatacattctgacactttaatttggtatctataatacctggaaagaggagcttgtctgttataaccgagatttcatgttagtagaagtagaatcattagggctgtcaacttgtcacctcctacctaacttttgctttccacctgacttgtctcagcagttgctttcaaaatcatcatcttcttcagatttttcaagttcttattctaaactcatctgacctgttttaggtgggacaagatgaggaaaactgttttttatattttaaatattagaagagctacaaatcaataggttttatactttcagataggttaggtcatgaataattacatttgaatttatttaagacaaatttagtgtgaacagtgaatttatttaagac

SEQ ID NO: 3083 - DNA, 2794 bp, Homo sapiens
agatatccaaggggaggcgtccaggaggtagttgggtttccaagtctggggttggaggggcaggtccaggctgcctgagggtaggggtagcatttaaggccatgcggtggggggagtggttcacggtggccctcaggaggaaggaaggaaaaacagccgtctctggcctctggcctctccaggctctccaccctgggggcagaatcaattctgtagccctctagcaccggcagtggctccgcagtcagctgggcagtggccgtgactgggtcactctaccctaggaagtgagtgcaggggctgctggagagccagaggctggcagcgactatgtgaagttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcactcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccaccagtacgtcgctgccccgccctcgggactccatccgcagctgtgccctcagcatggaccagatcccagacctgcactcacccatgtcgcccatctccgagagccctagctcccctgcctacagcactgtaacccgtgtccatgccgcccctgcagccccttctgccacagcattgcctgcctcccctgtcgcccgccgttccagtgagccccagctgtgtcccggaagtgccccaaagacccatggggagtcagacaagggcccccacaccagcccctcccacacccttggcaaggcctccccgtcaccatcactcagcagctacagtgacccggactctggccactactgccagctccagcctcccgtgcgtggcagccgagagtgggcagcgactgagacctccagccagcaggccaggagctatggggagaggctaaaggaactgtcagaaaatggggcccctgaaggggactggggcaagaccttcacagtccccatcgtggaagtcacttcttccttcaacccggccaccttccagtcactactgatccccagggataaccggccactggaggtgggccttctgcgcaaggtcaaggagctgctggcagaagtggatgcccggacgctggcccggcatgtcaccaaggtggactgcctggttgctaggatactgggcgttaccaaggagatgcagaccctaatgggagtccgctggggcatggaactgctcaccctcccccatggccggcagctacgcctagacctgctggaaaggttccacaccatgtccatcatgctggccgtggacatcctgggctgcaccggctctgcggaggagcgggcagcgctgctgcacaagaccattcagctggcggccgagctgcgggggactatgggcaacatgttcagcttcgcggcggtcatgggtgccctggacatggcccagatttctcggctggagcagacatgggtgaccctgcggcagcgacacacagagggtgccatcctgtacgagaagaagctcaagccttttctcaagagcctcaacgagggcaaagaaggcccgccgctgagcaacaccacgtttcctcatgtgctgcccctcatcaccctgctggagtgtgactcggccccaccagagggccctgagccctggggcagcacggagcacggcgtggaggtggtgctggctcacctggaggccgcccgcacagtggcacaccacggaggcctgtaccacaccaatgctgaagtcaagctgcaggggttccaggcccggccggagctcctggaggtgttcagcacggagttccagatgcgccttctctggggcagtcagggtgccagcagcagccaggcccggcgctatgagaagttcgacaaggtcctcactgccctgtcccacaagctggaacctgctgtccgctccagcgagctgtgaccccagggacatttcccctctgcagctgcggacagcgtcaggggcagaggggcacacaactttccccagagcaccccaaggacactgtgatcaacccgagaatgttctgggttcaactcaagcatctcccttgcacctccagggtcctgcgtggactctgggttccatcccacctgctacatgctcaccaggtctccattgaggaagaacaggaacgccggttcccccaccagcttttgctgctccccttcctgctggggttccctgttttcgagccatgggaggcaggctgctcacgcctcctcactctctgtctgtccctcaccaacaccaaggcctccatctcactgtaaataagtctctgttctgtaaatagatgtacagaagccatgttatttctttcatataataaacttttatgactcttt

SEQ ID NO: 3084 - DNA, 582 bp, Homo sapiens; identical to SEQ ID NO: 3048

SEQ ID NO: 3085 - DNA, 1017 bp, Homo sapiens
tgtggccggaggctgatcaggtactgtggacgggcggcggagttcgggagacaggggcagggcggcatcggggagctgcgggacggggcggggaggaggcccgaggtctgagccacccgtgaggtctcggcgcggaggcctggacagctgggggtggcggcgttggtctcccgaactggagggaggccgggccttcccgggctgtggtgggcgcccgcgccccgtggaaggcggaggcgtgagtcggggcgtcagagacgttgccattctttgtcagcggaaaagatcgtcgtctgcgcacagtcacctgaggtttaggaactcgtggaactggaaaccgagtcgcaggagactaagagttgcgagtctccccttagagaattcagaaacaagcgtagacagcatcgtcagaaacacgagcgtgacgacaccggcctccccgtgccgagtccacgcgtgtgacgcgggtgcatacacctgcgtccgtgcaagagggtgacagcaacacactcaaggcgcttctcctgggaatggagcaggagaagagatggggagcatcgcatagatggaactagacctttttcttgggttggatgatgtgttcccgcgtctactacatgtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagag

SEQ ID NO: 3086 - DNA, 2117 bp, Homo sapiens
ggacccaggggttacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttataatgcaaactggtcatttttgggattttgtttttgagactcattctgtcaccccggctggagtgcagtggcttgatcttggctccctgcaacttctgcctcctgggttcaggcgattcgattaacaattggagacgagtcgtgcagaggaaagaagtaacttagaatctaatctttattaacctgggatatcacagaaaatacttgggcctgccacttgtatttctttgtcctcaatactgaacactagacacatttgaaaccttcctcagaaggaaacaaaccaactggttatgcctgggtggtggcatggaagatgcccattgttgcccaatttgctaataagtattttgaaattagaaatgaaacatgaggtccaagcctgtccagttccctacccaacccattcctcctccctggaaaaaagaaacccgtatcatcttccaaatttctgattcatcactgccacttaaaaa

SEQ ID NO: 3087 - DNA, 7242 bp, Homo sapiens
cacaaattcgcagcaggcggctggggcggcggctggggcagcggctgcagcagcggcggacgctctgcattacccagtcttgcgtcctcggcaggcgcccgaagctgagtgcgcatcctctaccgcacccaagcttcgtctgtctcgtcaagctcttcatgctgcccaactaaaaggaaaacatgggcacaggggattttatctgcatttccatgactggaggggcgccctgggggttcagattgcaaggtggcaaggagcagaagcagcccttacaagttgcaaagattcgaaatcagagcaaagcctctgggtctgggctctgtgagggagatgaagtggtttccatcaatggcaacccttgtgcagatctcacctaccctgaagtcatcaagctcatggaaagcataacagactctctccaaatgctcatcaaaagaccatccagtggaataagtgaggctttgatatctgaaaatgaaaacaaaaacctcgagcatctcacacatgggggttatgtggaaagtaccaccctgcagattcgaccggccacaaagacccagtgcacagaattcttcctcgcccctgtcaagactgaagttcccctagctgagaaccaaagaagtggtcccgactgtgcaggcagcttgaaagaagaaacaggcccgagctaccaaagggctccccaaatgcctgactcccaaagaggacgcgtggcagaagagctgatcttaagggagaaggtagaagcggtacagcctgggcctgtggttgagctgcaactgtccctttcacaggagagacataagggcgctagtggccctttagtggctctcccgggagctgaaaaatctaagtctcctgacccagaccctaacttgtcacatgacaggattgtccacataaattcgatccctactaatgagaaagcagaccctttcctgaggtccagcaagataatccagatctccagtggcagagagttgagagtgatccaggaaagtgaagcaggagatgcgggactgccccgggtggaagtgatcctcgactgctctgacaggcagaagacagaagggtgcaggcttcaggcaggaaaggagtgtgtggattctccagtggaaggagggcagtcagaagcacctccttctctggtatcctttgccgtctcatcagaaggcacagagcagggagaagatccacgctcggaaaaagatcacagcagacctcacaagcaccgagcgcggcatgcacggctcaggaggagtgaaagcctgtcagaaaaacaagtgaaggaagcaaaatctaaatgcaaaagcattgcccttcttctaacggatgctcccaaccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttcttggtgcaagcgaatcagaggtggatgaagagttattgtctgacgttgacgacaacacacaagttgtgaactttgactgggattctggactggtggacattgaaaagaaactgaacagaggggacaagatggagatgttaccagacaccacaggcaagggagccctcatgtttgccaagaggagggagagaatggatcagatcacagcccaaaaagaagaggacaaggtaggtggaacgccaagcagagaacaagatgctgcccagaccgatggcctgagaaccacgacttcttaccaaagaaaggaggaagagtcggtaagaacgcagagctctgtgagcaaaagctacatcgaggtgagtcatggtcttggccatgttccccaacagaatggcttcagtgggacatctgagacagcaaacatccagaggatggtccccatgaatagaacggccaaacccttcccagggtctgtgaatcagccagctacccccttctcgccaacccgaaacatgacgagtcccattgctgactttcctgcacctccaccttactctgcagtcactcctccccctgacgccttctccagaggggtttcaagtccgattgctggcccagcacagccccctccatggccccagcctgccccgtggtcccagccagccttttacgattcgtctgagcgaatagcttcccgagatgagaggatctcagtgccagcaaaaagaacaggaatattgcaggaggccaaaaggagaagcacgacaaaacccatgtttacttttaaagagcccaaagtaagcccaaatcctgaactcttgtcactccttcaaaattcagaaggcaaacggggcactggagctggaggtgattccggaccggaagaagactacctcagcttgggggcagaggcttgtaatttcatgcaaagctcctctgccaaacaaaagacccctcctcctgttgctccaaaacctgcagtcaagtcctcatcctcccaaccagtaactccagtttccccagtctggtctccaggagtggctcccacccaacctcctgccttccccacatccaacccatcaaagggcaccgttgtctcctccatcaaaatagcccagccttcttaccctcctgcccggcctgcaagtactttgaacgtggctggtcccttcaaaggaccacaagcagcagtagccagtcagaattacacacccaaaccaacagtttccacaccaacagtcaatgctgttcagcctggtgcagtgggaccatccaatgagcttccaggaatgagtgggagaggagctcagctctttgctaaaaggcagtcgagaatggagaagtatgtggtcgattcagacacggtgcaggcccacgctgctcgagctcagtctcccactccatctctcccggccagttggaagtactcctccaatgtccgagcacctcctcctgtggcctataatcctatccactcgccgtcttacccactggctgctctcaagtctcagccatcagctgcacagccctccaaaatgggcaagaaaaagggaaagaaacccctcaatgcattagatgtcatgaagcaccaaccgtatcagctcaatgcatccttgtttactttccaacctccagatgcaaaggatggcctcccccagaagtcatcagtcaaggtcaattcagccctggccatgaagcaagctcttcctccccggccagtgaatgctgcctcacctacgaatgtgcaggcttcgtcagtgtactcggtaccagcctatacctctcctccttccttctttgcagaggcctcctcaccagtcagtgcatccccagtgcctgtgggcattcccacctcgccaaagcaagaatcagcctcatcatcttattttgtggcaccaaggccaaagttctcagccaagaaaagtggtgtcacaattcaggtgtggaaaccatctgttgtggaagagtaatcttgtagctgaagctgagtgtccactttgcttgaaatgaattgtttgcagtgtttcttgagtccctgagaatgcctagcaaagtcctcaacttacttaatttcagatatgtcacctcctaatctgggtccaaggagtataatatttttaatgagtcaaaaatccaactcagattgacctaaaatatatttatcttctttgcacacttaaaaaatccaggagcaccccaaaatagacatgtaccgttatattaagtaagcaggagacttaggatttgtgctgtagccacaagaaagacagtgatcagtgatatcaaacatcaggaatcagcctttatgtaacataacagctgtcctcctatggtgaaaggttcaaatgtagtgaaggtataacctatattgactgagatttcccttttaggtagtgccttatctctattactagtgttaaaggaataaggaatctatgaaggacagggagcagctctggtctgtcaatctcagccacctgtttgatatcacagagaagatactcggaggattgttggaatgtatatagtttagtaagaagtgggtaagaaagagggtcttaattactgagcacttattatgtattaggttctttgccagatgtttttacatatataaactcatttcagaaaacttatttaaagtaaatggggccgggtatggtggttcatgcctggaatcctagcactttgggaggctgaggtaggaggactgcttgaggccgggagttggagaccagcctgagcaacatagtgagaccctgtctcaataataataataataatagtaataatgaagtaaatgggataaggaaagaaggataattatctttaaaggttgattcccaccctccctccccagttacttaaggaactaagtgagtacatctccagttgcccatgaaagcataagtttgttttcctcagctgaggcaagtggtagagtatacaggataacgaagtaacatgtaaaaggcaggacgcacataaaggtgtacatggctattgtttcacctggagaaaccacatgattgggacctgaaggtttactgactgactacaggggctgattgtgaagcacgaggaaccccatgtgtgtggagactgtagggtgagagcacacaattattagcatcatttctgagtgatctcacagattttttttcttgtgtttgctttgctttttgacaactgcttctcccacgttccttgcaattctattctctcaccttcactttactatttgtattcgatggaccaggataattcaggcaaggttaccttgtaaactttaattggccacacaccatgttgtcacccagctggctatgaagtgaataatggtactgaaagtaaacctgaagacctttctcagatctattttaagtctgagtctgaccaaccatggaaaatattcgacatgaattaatgtagagaactataaagcatttatgacagctccaagaaaaatcatctactctatgcaggagatatgtttagagacctctcagaaaaacttgcctggtttgagggtacacagtaccattttaatcttctgaaaatatctgtattcctgctctttttctgctgtcactgtcaatctgctatatttttcactatcctattaaaatattactgtctcctttatctgttcaatgtccatattttaaaaaaatcttccttgtatgagctattctgatctaaataatttctctgatatttctctatatggctcccacaacaatttcattgttgttagcatatctatttctccatacattgtaaaactgtaatccttaggtatttctaaaacataaagaggagaattaagtcagctgcagaacaatggggctgattcttctgctttttctctggaaaatctttcattgcttttggtggaaatttacctagaggttacaaccacaggatgtagcttggtctcttatttgcctttttgggaaaccaattaagattaatacaggataaaggaaaaaagcaatctattcattatataacacagttgtttgtattacttgttccctgcaaaggaaatctgttgaatgcttgcattttgaattcttttctaatagaacaaccaaaaaaggcttcttatggtgcagcaggaaaaaagatcatttttatagctttgcattcttaacatagcatttaaagagcggcatgaattagaggaaagacatggaacacacaggtagtcggtttgagatcatcggcttaaaagtatcctaggatggtaatgacccagaagtatttccagttgtctagtggtgtggtatgcaggaatgagaagtgttttctttccatttcctgttggacaggtggcaatcttagcagagccactatttggagttgataactaaagatgcaaataacatgactatgccttctggtcatcctaggactatttggagttctccaaaaccttgtaagaggcatgtcaggcatgcagtaaaagcatctacaacttcagctgggcactggcagcataggtctcatcttggaccatacagtcccactttatagaagagggtggaagttctccaaaacaatatccacaacaaagtctgacctcactctgagggagatgggaagtgggaggaagaaggactaaccagctccctggagtaagaggaatttgctttccctgtctgcccaccaggggctatatgtgccacctttcaggttggggccaaggaagtgatgtcagtgtgacagaagggagagttagacctccagacgtcagcctccctcccatggggtacattttcaatctgagtgttgttgccttagctgtgttggtattagcttgattggttggtccgctggttatgaggtgtagggaggcagtttttgtttagtttttaggactttgcctcttcctttgtccttagcataatttctaggcagagcatccacgaagtcggttttcattgccagctcaagagcgacaatcatttacgagttcctatgttatgttaggtgccttatgtatattatcccaaatccactgcatggtttaaatacaggcactggaatataaatgaaaaaggtcattacagtcactgactttctgcaggaccttaaacatttctctttccacaagtttccccttaatcatgtgtcaaacctctcttcctgacgggaatgttgtgctataatgaatctgcataacgcttgggattctaggaggaaggaaggttccatggacatgtaagtacagcatattcccctcagtcttctaggagggcagagtgaatcccagaactggtaagattgggaatctgagcattgccactttaatcttagaatatttatcattttgacacatcctgttttttagagaggaaaacaaacacagtttctgcattggtagtgtaaagcataccttgttaggaacgtgttttgtaagacacatttgggttgtcactctagagcatgtcaaactttgtacttcaaaatatatttagtatgattgttagtggtaacatatatcaaggctttgaattaactgttttatttaattttcacaagaagcacttattttagccataggaaaaccaatctgagctacaaatagttctttaaaataagcccaggttatttagctattctagaaagtgccgacttctttcaagaagcaggcattgtaggacagctgagaattatcacatagcctaaattctagcctggcagcaagagtcacatctgagatgtccaaaaaaaaaaaaaaaa

SEQ ID NO: 3088 - DNA, 701 bp, Homo sapiens
cagaggagggggctctgctggggagaggggctcagtctgttcttgtgaggctgagggtctggggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgc

SEQ ID NO: 3089 - DNA, 2484 bp, Homo sapiens
ggatgccagctgagtgctggccgtgggcccctggtcctggcacgagaggagcctctgttcccaaagctggggtagatgtgttgctggactcacgtgcacacacacacgtgcatgggccgagggcagggcccgcagtcccctggtgtgggtagaacaccctgaccatctctggcgtggagagggccttccatcccccagggtgtgcctcagggccccgaagcccaggctggccctccccactcttcctgtactcctggctcaggcccctggtgcctttgggtccccacgccatctgcccatgggcctgaggccctaggcctggggagggctgtcccatggatctctgccgcagtactgtggctcagtgaagggtgccaagtacacctgtgccctccgctggtagctgctctaacacccttctgagcccgcaggccccatgaccagggagggagggagggctgtgagcagagtcctgccctgccccccagatgtccatgggcacagcaagcggggatggtcctctgtggccaccagagctggcctcctacctggggtggccggacatccgcgtctgcagagcggggcccaccccgcccgccgaggcagctgagctgtcctgcgagtggattggtttgaggtcaaggtgctgctgctactgccttctgccctgtgcacccacctacccacccacgatcccagtggagcctctttcctgactcccagcatcctcccacagccccaccccaactgctggctgcactgggcaggccttgcgtatggctggaggctgaggcagggttcgctggaggaaggggtggggcggggccgagggtcacccctgcttggtggagcctgctgtccctacccgacgtggtgcactggtggtgtttgacccaagcatgcggctcgccatcatgccccgctacagtgcaggagcgcagctgctgccaggcttagagcaggggctggtgaggaggccaggactctgcccaggagggcggaacctgaagctttgggtctgacaaactcaagcaggcagcagggagggactgcagtggccttgcttgcgctctgactggtccttgcctgtctgtgtggtccagcctgggccgcagcaggtcctggtggggaggtttactctgttttggggtctgtcaggcactgctttcccaccacctgtaagggggtttcccacctaatcagctgcagactgctcccgggttgcagccactggcctgggagcaccaggccgccttccccgcatgtgccctgggctggtgggggccttgtggtccctggagctcagcagctgttgatgtttcaatgaagggctactgggtgggggcaccagcctcgacgctgcccagccctgcagcactgagccctctcccagagggaccctgggactgccacagggtgctgagtgctgctttgttctgttcttgcttctaaaaccaattcactcaccaagacacgaggcgccggcagcagggctcggattacacgtccacctctgaggaggagtacggctcccgccacggctcccccaaacacacacgctcccacacctcaacagccactcagaccccgagggctggcagctccagccgggctcgttcccgggcccccggcccccgggacacggacgacgatgaggaggagcctgacccttatggtttcatcgtgcagacggcagagattgcggagattgccaggctgagccagacgctggtgaaggacgtggccatcctagcccaggagatccacgatgtggctggggacggtgacacactgggctcctcggagcctgcccacagcgcctccctcagcaacatgcccagcacccccgcctcgaccatctctgcccgggaggagctggtgcagcgcatccccgaggccagcctcaacttccagaaggtgccgcccggctcgctgaactctcgggactttgaccagaacatgaacgacagctgtgaggacgccctggccaacaagacgcggcctcggaaccgagaggaggtgatcttcgataacctgatgctgaacccggtgtcccagctgtcgcaggccatccgtgagaacacagagcaccttgccgagaagatgaagatcctctttcagaacacagggagagcttgggaggacctggaagccaggatcaacgccgagaacgaggtgcccatcctgaagacatctaacaaggaaatcagctccatcctgaaggaactgaggcgggtgcagaaacagctggaagttatcaatgccatcgtggaccccagtgggagcctggacctgctcctccccacactgagctcctttgttcctccccctccagcctttgcctgggaactggtccttgtttgccgggcttctcggagggttcactgtacattcgttctcaggtggtcttgtggctgtctttcggaaaatggttattttatatgatttgtcatggaatttgttctaataaatcattcttctatc

SEQ ID NO: 3090 - DNA, 395 bp, Homo sapiens
tgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaaga

SEQ ID NO: 3091 - DNA, 902 bp, Homo sapiens
aaatttgcgcgggttggagcctggcgtagtcatggccgccttccgcgacatagaggaggtgagccaggggctgctcagcctgctgggcgccaaccgcgcggaggcgcagcagcgacggctgctggggcgccacgagcaggtggtggagcggctgctggaaacgcaagacggtgccgagaagcagctgcgagagatcctcaccatggagaaggaagtggcccagagccttctcaatgcgaaggagcaggagcgacaggagaaggaggtcgacgaggacacgacagtcacaatcccctcggccgtgtacgtggctcaactttaccaccaagttagtaaaattgagtgggattatgagtgtgagccagggatggtcaaaggcatccatcatggccccagtgtggcccagcccatccacctggacagcacccagctctccaggaaattcatcagcgactacctctggagtctggtggacaccgagtggtagccaggagcctcgtggctgcgtcttgcacccagcgggcatctgccgtggtcagatccatttcaaatgaaatgtggggacatagatctttttttttttttttttgagacagagtttcactcttgttgtccagtctggagtgcaatggcacaatctcagctcacagcaacctctgcctcctgggttcaagcgattctcctgcctcagcctccaaagtagctgggattacaggcatgcgccaccacacccagctaattttttgtatttggtagagatggagtttcaccatggtggtcaggctggtcttgaactcctgacctcaggtgatccacccgcccgccttggcctcccaaagtgctaggattccaggcgtgagccatcgtgcccagctagacgtcttcctttttttttttttttt

SEQ ID NO: 3092 - DNA, 524 bp, Homo sapiens
gggccatctggccatgagcacttctctctctgtctgccacgacaggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagaccc

SEQ ID NO: 3093 - DNA, 3383 bp, Homo sapiens
cctcctgacgagaaccaaggcgtgtggggacgcagggcctctgcgtgtcagggagcagaacctgggccgagccctaggtgaaggggcggggtggttggccctgagccaatcatggctcgtgacgactcggctcggccaatcagaagaagggaggcctggcgctctcggggcgggtgagaaaccgcccccccttgcagctccgcggccaacgccttcgcccaggggtagttggagcggtgcaggttcccaggctccaggtactgggcgccttacgagctgggaggtggtgcctctcacccagctaattgctctctagcccttggccttcacaggtgttggtgcctgccgtgaacgcattctgacctgggccgtatctgtctcccaagactttgtgcctatggttggggacagagtgaggtcgttgccttgacgacgacagcatgcggcccgtggtcctcctaagtgtgagcttgcggcggaccgaggcccacctgcctccctgcctgcttcgccctggactcgtgactgcgtccgcagaagaaatcacaacagcgctggaattgctagtttgctaggcagcatcttttggacctgcgaaccatatgcatttcacctcaaatttgtttccaagttgaaaacctttgggtctttctatgcgaacggattgaagaaacgcaaaaagtttctacggactttaaattaaaatggaaaaatatgaaaacctgggtttggttggagaagggagttatggaatggtgatgaagtgtaggaataaagatactggaagaattgtggccataaagaagttcttagaaagtgacgatgacaaaatggttaaaaagattgcaatgcgagaaatcaagttactaaagcaacttaggcatgaaaacttggtgaatctcttggaagtgtgtaagaaaaaaaaacgatggtacctagtctttgaatttgttgaccacacaattcttgatgacttggagctctttccaaatggactagactaccaagtagttcaaaagtatttgtttcagattattaatggaattggattttgtcacagtcacaatatcatacacagagatataaagccagagaatatattagtctcccagtctggcgttgtcaagctatgcgattttggatttgcgcgaacattggcagctcctggggaggtttatactgattatgtggcaacccgatggtacagagctccagaactattggttggtgatgtcaagtatggcaaggctgttgatgtgtgggccattggttgtctggtaactgaaatgttcatgggggaacccctatttcctggagattctgatattgatcagctatatcatattatgatgtgtttaggtaatctaattccaaggcatcaggagctttttaataaaaatcctgtgtttgctggagtaaggttgcctgaaatcaaggaaagagaacctcttgaaagacgctatcctaagctctctgaagtggtgatagatttagcaaagaaatgcttacatattgaccccgacaaaagacccttctgtgctgagctcctacaccatgatttctttcaaatggatggatttgctgagaggttttcccaagaactacagttaaaagtacagaaagatgccagaaatgtttctttatctaaaaaatcccaaaacagaaagaaggaaaaagaaaaagatgattccttagttgaagaaagaaaaacacttgtggtacaggataccaatgctgatcccaaaattaaggattataaactatttaaaataaaaggctcaaaaattgatggagaaaaagctgaaaaaggcaatagagcttcaaatgccagctgtctccatgacagtaggacaagccacaacaaaatagtgccttcaacaagcctcaaagactgcagcaatgtcagcgtggaccacacaaggaatccaagcgtggcaattcccccacttacacacaatctttctgcagttgctcccagcattaattctggaatggggactgagactataccaattcagggttacagagtggatgagaaaactaagaagtgttctattccatttgttaaaccgaacagacattccccatcaggcatttataacattaatgtgaccacattagtatcaggacctcccctgtcagatgattcaggggctgatttgcctcaaatggaacaccagcactgagaaccattttggttctgaactggatgatgctcttgcacttgagatgacatcttcttgcagcaagagtgctgatatcccaagaggagagattcatggttttgatcatttccttctgaactgcctgcattttctgaggaaggccttctagaagaaggaaagacaaagacttccaaatgtttcaaaggaagattgaacaaatggccctccccaactgttatcccattacctttcacgtccaccgatgctatttcaagacatatccagtggaataacagtgatatggttcttgttacatgaatgtgtatttactgttaggagattgtatattttaagttaccatgattaaaagtgtgtaaaaaagggggacagagagaaatactataaaaggccatgttactcatgcattgaactttgtgtgttttctgtataaatgtgtacatttatttaggagtgggtttcttgggggtaggtgataaaaattaggatcagttgaagaaaattgaagaaactaggatcagtaagagaaactgtttgctttacctgaatttaactatgaaaacacacttaacaatcttacacgtttctagatattaagtgaatatgtaactcctgtccatgggtagatgtgtatctttgacttctgtaattatttttgatattctatcagtgtattatgagactctggcctccctgcagatcttctaagaaccacactaatgcaagcgtgacagagaaacctctttcgaatgacttactacaactctggcattggttagttccatgtattgtaagattctggtgctaatgctccatacagaattgatcaggactgattactcttctgtggaccaattgctattgaactacccagctgaagagggtttggggagagaacgttcattattatggactccacttttgtcccctggtagtttaagggtgatactagaatccagagaagttcctgtctccttgtggcctcaaacactcaggccgtctcaaaagcttttcaccaaggtgcaaaatcatttacctgcattccacacatcttttccaatgcatggatccaaaactttttaggtgggaggaataaactaagttggctacaggttcttgatttctgggtttctacacatgctctgcatttatcattttagagaatggttgtttagggaaccagaatttgtgagttttttt

SEQ ID NO: 3094 - DNA, 6455 bp, Homo sapiens
agggggcagagtgtcctcaccaaaataagacagttttgcacatggatggatgtttagacactgagactcctacggtgtccattcaagaaaatgtggatgtagcctctttgaagcccattagtgacagtggaattaatttcactgatgccatttggtcaccaacttgtgaaaggcgaacatgtgaatgtcacgagtccatcgaaaagaataaagacaaaacagatctcccacagagtgtggtctatcaaaatgaagagggtaggtgggtcacagaccttgcctattacacatcttttaatagcaaacaaaatttaaatgtgtctctaagtgatgagatgaatgaagacttcagatctggttctgaagcatttgatttgattgcacaagatgaagaagaatttaataaagagcatcaatttatacagccatcatttggctattttattagatcaccagagaagagagaacctattgccttaataagaaaatctgatgtatcaagaggtaatttggaaaaagaaatggctcatcttaaccatgatctatattcaggagatttaaatgaacagtcccaggcacagctaagtgaaggatcaattacacttcaggttgaagcagtagagagtacttcacaagtggatgaaaatgatgtgacgttaacggctgataaaggcaaaacagaggacactttcttcatgagcaacaaaccccaaagatacaaagacaagctaccagatagtggtgattctatgcttaggatcagcaccattgcttcagccattgcagaggcatcagttaatactgatccttcccaacttgctgcaatgatcaaggcactttcaaataaaaccagagacaagacttttcaggaagatgagaaacaaaaggactattctcatgtgcgtcatttcttacctaatgatttagaaaaaagtaatggatccaatgcacttgatatggagaaataccttaaaaaaacagaagttagtagatatgaaagtgcattggaaaacttttcaagggctagtatgtctgatacttgggatttatctttgcccaaagaacaaactactcaagacattcatccggtggacttaagtgctactagtgtaagtgtgagggcaccagaagaaaacacagcagctattgtttatgttgaaaatggagagagtgagaatcaagagtcatttagaaccataaactcctcaaattcagttacaaatagagagaataacagtgcagtagttgatgtgaagacatgttccattgacaacaaattacaagatgttggtaacgatgaaaaagctacctcaatttccactccatctgatagttattcatcagtgaggaaccccagaataacatccctttgtctgttaaaagactgtgaagaaatacgagataacagagaaaatcagaggcaaaatgagtgtgtcagtgaaataagcaacagtgagaagcatgtgacttttgaaaaccatcgcatagtctcacctaaaaatagtgatttgaaaaatacctctcctgagcatggtggacgtggctcagaggatgagcaggagagcttcagaccttccacgtcaccactgagtcattcttctcctagtgaaatttctggaacgagttcatcagggtgtgcgttagagtcctttggttcagcagctcagcagcagcagcctccctgtgagcaggagttgtctcccttggtgtgctcgcctgctggggtgagcaggctgacgtatgtgtctgaaccagagagctcctatcctaccacagccacagatgatgccctggaggaccgcaagagtgatatcaccagcgagttgagtaccacaattattcaaggcagtccagccgcattggaggaacgggctatggaaaaattgagagaaaaagttccatttcagaatagaggaaaaggaacattatcatctattatccagaataactctgatacaagaaaagcaactgaaactacttctctgagtagcaagcctgaatatgtaaaacctgactttagatggagtaaagatccttcctccaaaagtggaaatctgttggaaaccagtgaggtaggttggacatcaaaccctgaggaattggacccgatcaggctggctctcctgggcaagtcaggtctgagctgtcaggtggggtcagccacatcacaccctgtgtcctgccaggagcctatagatgaagatcaaagaataagtcctaaagataagtcaactgctggccgtgagttcagtggccaggtttctcatcagaccacctctgaaaaccagtgtactcctattcccagcagcacagttcacagctctgtggctgacatgcagaacatgcctgctgctgtgcacgcactcttgacacaaccctctctcagcgctgctccttttgctcagcggtatttgggaacactcccttcaactggaagcaccaccttgcctcagtgccatgctggcaatgccacagtctgtggcttctcaggaggccttccctatccagctgttgcaggagagcctgtgcagaactctgtggctgtgggaatttgtctaggatcaaatatcggctctggatggatgggtacctcttccctctgtaacccatattctaataccttaaatcagaacctgctaagcacaacaaaaccttttcctgtgccgtctgttggtacaaactgtggaattgaaccatgggattcaggagtgacatcaggattggggagtgtccgagtgcccgaggagttgaagcttcctcatgcttgctgtgtcgggatcgcttcccagaccctcctcagtgtgcttaatccaactgaccgctggctgcaagtcagcattggggtcctcagcattagtgttaatggtgaaaaggtggatctttcaacatatcgttgtttagttttcaagaataaagccatcataagacctcatgccacagaagagataaaagtgctttttataccatccagtcctggggttttcagatgcacattcagtgttgcttcttggccatgttcgacagatgctgagaccatcgtacaggcagaagctttggccagcaccgtcactctcactgccattgccgagagtcctgttattgaggtagaaacagaaaagaaagacgttcttgattttggtgacttgacttatggaggctggaaagccctcccactaaaattgataaaccgaacgcatgccactgtgccaattagactgattattaatgctaacgctgtagcctggcgctgtttcacgttttccaaggaatccgtccgagctcctgtggaagttgctccttgcgctgatgtggtcactcggctagcaggcccttctgtggtcaaccacatgatgcctgctagttatgatggacaggatccagaatttctgatgatttgggttcttttccatagtccaaagaaacagatcagctcttcagatattctggactcagcagaagaattctcggcaaaagttgatatcgaagttgacagcccaaaccctacgcccgttcttagaagtgtgagtctccgagcaagagcaggaatagctaggatccatgctcccagggacttgcagacgatgcatttcttggccaaagtggcttcctcaagaaagcagcacttacctttgaaaaatgctgggaacattgaagtttatttggatatcaaggtcccagaacaaggaagtcacttttcagtggatccaaagaatctactccttaaacctggagaagaacatgaggttattgtttcatttactccaaaggatcctgaagcctgcgaggaaaggatcttgaaaatatttgtgcagccatttggacctcagtatgaggtagtgttaaaaggcgaagtcatttcttcaggaagtaaacctctgtcacctggaccttgcttagatattccatcgattttgtccaacaaacaatttctggcttggggaggagtccctctaggtagaacacagcttcagaaactagctttaagaaataattctgcatctacaactcaacatttacgactgcttattagaggacaagatcaggactgctttcagcttcagaacacttttggttcagaacagcgattgaccagtaactgtgagatcagaattcacccaaaggaagacattttcatctctgtattatttgcacctactcgattatcttgcatgttggctagactagaaatcaaacaacttggaaatcgatcacaaccaggcattaagttcacaatacctttgtctggatatggaggaacaagcaatcttattttggaaggcgttaaaaaattatctgacagttacatggtaacagtgaatggcttagtacctggcaaagaaagtaaaattgttttttctgtccgcaacactggctcccgagcagcttttgttaaagcagtaggttttaaggattctcagaaaaaagttttgctggatcctaaagtattgaggatttttccagataaatttgtactcaaggaaagaacacaagaaaatgttactttaatatataatccatcagacagaggaatcaataataaaactgcaacagaactatcaactgtatacttatttggtggagatgaaatttcaagacagcagtatcgcagggccctgttacataaaccagagatgataaaacagatacttccagaacatagtgtgcttcaaaacattaattttgttgaagcatttcaagatgagctattagtaactgaagtatatgatcttccccaacgacctaatgatgttcagctcttttatggaagcatgtgtaaaattatactttcagtaattggagaattcagagattgcatttctagcagagaattccttcagccttcttccaaagctagcttggaatctacaagcgacttgggagcttctgggaaacatggtggcaacgtctctttggatgttttaccagtcaaaggtcctcagggttctcctcttctctcacgggcggctcgcccgcctctggatcagctggcctccgaagagccgtggactgtcctacccgagcacttgattctggtagctccttctccttgtgacatggcaaaaactggacgtttccagattgtgaataactctgtgaggttactgagatttgagctgtgctggccagcgcattgcctcacagtcacgccgcagcatggatgtgtcgcgccagagagtaaactacaaattcttgtgagtcctaattcctccttatccacaaaacagtcaatgttcccgtggagtggtttgatctatatacactgtgacgatggacagaagaaaattgtgaaagttcaaattcgagaagatttaactcaagtggaacttttaactcgtttgacctccaaaccatttggaattctttccccagtatctgagccttcagttagtcatttggtcaaaccaatgacaaaaccgccttccacaaaagttgaaataagaaacaagagtattacttttcctacaacagaacctggtgaaacttcagagagctgtctagaactcgagaatcatggcaccacagacgtgaaatggcatctgtcatctttagcgccaccttatgtcaagggagttgatgaaagtggagatgtttttagagctacctatgcagcattcagatgttctcctatttctggtctgctggaaagccatgggatccaaaaagtctccatcacatttttgcccagaggtaggggggattatgcccagttttgggatgttgaatgtcaccctcttaaggagcctcacatgaaacacacgttgagattccaactctctggacaaagcatcgaagcagaaaatgagcctgaaaacgcatgcctttccacggattccctcattaaaatagatcatttagttaagccccgaagacaagctgtgtcagaggcttctgctcgcatacctgagcagcttgatgtgactgctcgtggagtttatgccccagaggatgtgtacaggttccggccgactagtgtgggggaatcacggacacttaaagtcaatctgcgaaataattcttttattacacactcactgaagtttttgagtcccagagagccattctatgtcaaacattccaagtactctttgagagcccagcattacatcaacatgcccgtgcagttcaaaccgaagtccgcaggcaaatttgaagctttgcttgtcattcaaacagatgaaggcaagagtattgctattcgactaattggtgaagctcttggaaaaaattaactagaatacatttttgtgtaaagtaaattacataagttgtattttgttaactttatctttctacactacaattatgcttttgtatatatattttgtatgatggatatctataattgtagattttgtttttacaagctaatactgaagactcgactgaaatattatgtatctagcccatagtattgtacttaacttttacaggtgagaagagagttctgtgtttgc

SEQ ID NO: 3095 - DNA, 7948 bp, Homo sapiens
gcgcggcagccgggccttgctccgggacgtgtttatttgtaacttagtgctttttatcgtcttaaggaggtatttggtggaggctctttgaagttgggttcaggagtgtagaattggcaaagttattgccagcttcctgcatcaacaacagcaacttgtgattggcggtgaccggatattcagttgcacatccccacatcaatgcactgccaatgggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaaataatcatactgatatgatggaagtggatggggatgttgaaatccctcctaataaagctgttgtgttgcggggccatgaatctgaagtttttatctgtgcctggaaccctgttagtgatctcctagcatcagggtctggagactcaacagcaagaatatggaatcttagtgagaacagcaccagtggctctacacagttagtacttagacattgtatacgagaaggagggcaagatgttccaagcaacaaggatgtcacatctctagattggaatagtgaaggtacacttctagcaactggttcctatgatgggtttgccagaatatggactaaagatggtaaccttgctagcaccttagggcagcataaaggccctatatttgcattaaaatggaataagaaaggaaatttcatcctaagtgctggagtagacaagactacaattatttgggacgcacatactggtgaagccaagcaacagtttccttttcattcagcaccagcattggatgttgattggcagagcaacaacacctttgcttcttgtagtacagatatgtgcattcatgtctgtaaattaggacaagacagacctattaaaacattccaaggacatacgaatgaagtaaatgctatcaaatgggacccaactggcaatctcttggcctcctgttctgacgacatgactttaaagatatggagtatgaaacaagacaattgtgtccatgatttgcaagcacataataaagaaatttatactatcaaatggagtccaacaggaccagggactaataatccaaatgccaaccttatgttagcaagtgcatcctttgattctactgttaggttatgggatgtagaccgagggatatgcatccataccttgacaaaacaccaagagcctgtgtacagtgtagctttcagtcctgatggcaggtatctggcaagtggttcttttgacaaatgtgtacacatctggaacacgcagacaggtgctctagttcacagctataggggaacaggtggaatatttgaagtttgctggaatgcagcaggagacaaagttggagccagtgcatcagatggttcagtttgtgtattagaccttcggaaatagcgctactagttggaagccatggaccgactatgaatgtgtacatagccaaaatgactgtccctgacccatgtactgctatagtcccacttgaaccatggccagtccactacagccaaatctaaaagaaatatatacatacagtgtatataaacaaaattgcaccctgaagatgacagagttttgtcacagcttgtgaattctgttcaccaagtgctggaatctaatctgctgtgcccctaaaatagcatttagaagttttggatatgaaaaacagaagagagaaaaatatacattataaaagcagaacatacatgtaccagtttttggatactaaatgacagccttgtttctcccctttgaatcagcagacaccatggattatattctttttttcccttcagtagtgagcagtttgtatgtacagagaaaatggacttacaaaaacttgcagcagtagtttgttcttgctttaaaatttcgtttttggtttagattatggatgcatgaagtaagggagtgaatcagtttcttgtttatatttttttcaccttttaaacaaaaaattctttaaaatattttaatgcattcttttgaagaggtagatgtttggtacattttatggctcccagagcatatattcagttggtgcatgttgtggaagggggaattggaaattaaatgaaaacctatgactttggtcatgtcaatctgtaagacacatcagtaaaagggtattatgctctgttggttttgtttttttgttttgctttttttttttttttttcttttttgttttttggtgatgtggcttaaatgcaatagtttcttttttgggacatatttctgccaattaaagactagaagggcacaactttttttttaattaccatagagaagatacattaaaaaaaatcttctgatgttttgtagccataactaaattatggtaaaaatgtgcactattgtgaaaaggagcaacgtagttttgggttttttgttgtttgtttgttttgctttgttttttaagagattaaaatgtttctggataaggattagcttctcgaagtgtccatcattctgtgtagaagcttaaatatgtaatgtaaccaaactccagtattaaaaatctctcatgttgttttctttatacaaagcaagataacggcatataacactgccattacatggcaaaatgtttgctaccttagtttaaaaaacaatctcaaacaaaagacttgcttcaaggtgtttttaaatagcagtgattcagaattttttttaatgaaagtataattgcactaaccttcttcctgctgctctgattctgcatttgtggtacttgtgactacgttttttcaaatatagatagatttaagctgctaatttttttttttttagtaatcactactatatcatgtcttttactctgtttataatatcaagtattttcttaaagatatagatattaaaccttgtgctcatgcaacttagagtaacatatacagacaaatgattgcatgaggccatgtttatatgtgtgactaataaggcttgtcatgattaacataatccaggtatgtcatttctgaagagaatagtcatcaaatttatatctcgaagattttaattaaggaattgcttattgttgagcttagcaaattaataacactatttctgtcactaattattttgaggccttttagtactaaaattttaacctgtgttctaagtagaaactgatttaacccaagtaatgcagctttgattgatttcagcattcgttgctttgctatttttacaaaacagcattgattgaagcaagtcttggttttactaaggtagggtagcatttgctattggtaaagagaataaatacacttaatttcacaatacattgttatatgtaccccagttgttgttagtggggactatgatactgtaataatatttttaaaaatttacatcaagagaggcagtcattcacgatggttttgtgccagctctttttagggttttggatcacattagagatatttagaacatattaccctgtgacttacgtaggaaacctaatatgctgagtatctggcacttgaattcctgcttttattgctggaggtccacatctgtggttgacctctgttattgtttaaaaaaaataaataaaaattaaaaaaatctgtgcaataattttaaaatgtgctcccaggaatagacacaaatgttttgagtatcttttaagctgcattttcctttagtgatgcatttgtcaattgcactgaatttaaatctgaaagtcagaggtgattattgatagtacttttgtattttgatatggacagtttattcatttgcatacagttattgactttttcccagctgattaaaagatagtcaagaaattctgcaatatagctgccaaaatagacagctacatttttatgatattgtcatcttttctgttttttttttcttttttttctttagctattttacttaagcataatagccacaataggacatataaaagattataaatacagagctttattatcctgacgtcttgggtcttttaagtatatacttttctgaaaggtatccattttgtaggcttgggttcttcatgagcatacgattgtttatttttgctgctgttctcaacatcatcattgcctgctgatgtgccacgatgctgctccaatagacagcaataagattgtctctaatttgagcagtaacatgattgcaagagaccaagtttcacagcttgtaaagttctgtatttgggattcttgcttatttttccgcctgtgtttttctgagaacttattcctgatgatcaattgaatccagtagtttttctatgctatttgttgttgtataagctactgtaagaaacttatcataaggaaaaatagaaaggaaaacttgaatcaatactcattgattaaaatggaataaagaaagagcagctgccacttttaaacaacataaaggaatatctttttttgtctccgtgtaggaaatcccataagttcttatatttgttccagttcccatttcctgccattgaccagataacatcattgactttcaaatgacttttagaagtgataactcttaatttcctaatagatactagattgtattgaattctgttttaattattctctaggtaagtatgttttaggattaaataccttttacagatactgaaagtgcctccttttgtggtgtaaaaaacaaattatggtgcaaaaagtaatcactagattgaaatacatgaaggttttttgctttttgacatacgaaaatgtcaagagaaaggccaaagatttgtactttttcacttacaaagcactcctttttcccttaaacttctttctgtcaaattagatttaatgagagagtactatttttaaggagctatctgtttatgtagaatgattttgttaagagtaatgtaaactattattgagtagaggcctaaagaggactgtgcatttttgctatttaaaggaatcacaaatgatcatacttaagtgagcaaaaatgacaagttttactagctaagtagagaaataaatctcaaatgcagcgctacaattttcattatcttaagtacattgtacatttctacagaacctgtgattattctcgcatgataaggatggtacttgcatatggtgaattactactgttgacagtttccgcagaaatcctatttcagtggaccaacattgtggcatggcagcaaatgccaacattttgtggaatagcagcaaatctacaagagaccctggttggtttttcgttttgttttctttgttttttcccccttctcctgaatcagcagggatggaaggagggtagggaagttatgaattactccttccagtagtagctctgaagtgtcacatttaatatcagttttttttaaacatgattctagttaaatgtagaagagagaagaaagaggaagtgttcacttttttaatacactgatttagaaatttgatgtcttatatcagtagttctgaggtattgatagcttgctttatttctgcctttacgttgacagtgttgaagcagggtgaataactagggcatatattttttttttttttgtaagctgtttcatgatgttttctttggaatttccggataagttcaggaaaacattctgcatgttgtatctagtctgatgtacttatccatctcattacaaacaaaaacacacagactgcatttgtagctctgtaatccttgaatacggaagtaaattttcttctttcctgactttgacattgtagctatactgtttccatttttgtttttacaaatcctttgggtctaattctgtgagcctacctatagcactggattaaaatgtctgcatcatttctttagttatccagttaactttaaaactgttgtaaaagtgtaaaccagcccatgacaggtttttgtacatgttaaagaacttcattgttcagttttcatgattattgtgtaaggaagactgatgtagatgttctgtgctgtcctggaccatgttaattacacttacgacgtattttagttccacatcacaatgatttgtccccagtgacccttttatcctttctaggcacatttcttgttgttgttgttgttgcagttcccctttgcattgtattgctttgacaactgtaatttgaatcagatctgaaagaggtccagaataaaatatattttgatattatgttggctgtgtacatatataaaacctttgatgtctatgtagtttatatagactatttactagtcaggtaaagagagagggatggtatttcttgtttacagtttgtttacattttaattgcttttacttctccagtgttctattgtagaataaacctttttttccaagttagccttcataacctataacacattcattctctcccatactggtgttactgattaataactgccatcagaacccaaaccactgtttttcataaacgtattgtttcccaagatatatactttaagcccataataaaattacaaattttactatttttattacttcttgcaggagataagatttttttaaatgaaggggttatttactatttttattaaagtataatagagcatctaatcagctaagggattgtaatttttaattcttttgaaaaataaatattgtatttaaaagacgttatttcacagaagctgaaaaagagaccttagataacatttgtttggttagccacacggttgagcacaaaacaatgtgtagatgtgttgaagattagggcaggaggctcaacttctcggtgacctttttttgcttcacaacaagccaattatagttgaatcattttctctcttagctagttgttactacaaactttataagaaaaacaactagacaccttctagttttaattaataccaactcctttagagttagagactttttaaaaagaatcattgagcatattttcttttttttttttttaagaatttacactctctaggtcttctatttttcctgtttatttccttaaacagaaataaattcaagcatagttttatgttttattagaaataagccactgcagttgctagaactgacatgctttcattttcaaggggttaacttttattgcatggcatagattattagtaatatcctgcattgtatacttttccaaaaagggttggactcctaaggattagaatccttataagcttgagggaaagctgaaactaatttgaacagtaatagaagggattatttttaatttcatagttaacactttacaatggattagatttattacctagtataatccgtagcagatcagatcaaagtttactgttttaccaatatattcatttgaaaaaatacagtggaggaaaagacactttagatggtagttttatggtgcttttctctgctgtaccaaagtgctttgtcatcaatgaaatgttaaccctatgctactttttctgcatgcttcttaaatgtcatcttaatgcttaattgtcctaacttgtaatatttttgtattaaatttttttaggagttccttgtaatttctttacaatttaaaatatattaaacacaaagtgtttagtaaagtaca

SEQ ID NO: 3096 - DNA, 2335 bp, Homo sapiens
aaaatgctcccgccgacgcacagcagtgacgacacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggtcacattcactaaatgtctatatgcacaattggtgcaacaaaggtttgtgccagaccggcggagtggatacaggctgcctcctccatctgatccccagtaccgagcccatgaattgggcatgaaattggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaaggttggaggtgcagtggcgcgatcctggcttactgcaagctccacctcctgggttcacgccattcatctgcctcagcctcctgagtacctgggacaacagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaaccagcacatttagcttctcttttttctttttaaataaatattgaatatgattctgttc

SEQ ID NO: 3097 - DNA, 2706 bp, Homo sapiens
gtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggccgagctggagcccttgaaggagcagcttcgaggggcccaggagcttgcagcctcaagccagcagaaagccacccttcttggggaggagttggccagtgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgt

SEQ ID NO: 3098 - DNA, 3452 bp, Homo sapiens
aaagcgttacttccggcggaaaaggacgcgggagattcgattggaaggctgccggcgtgctactgagttcggccggtccgagtcactgtgcgtcgcctgggcccgttcctggtcttctcccccagggtcttgctctgtcacccaggctggagtgccatggcatcatcatagctcactatggccttgatcctcctgccttagcctcccaagcagctggtattacagatggagttttgctcttgttgcccaggctgaagtgccatggtgcaatctcggctcactgcaacctccgcatcctaggttcaagcaattctcctgccgcagcctcctgagtagctgggattacaggcaccccccaccatgctcagctactttttgtatttagtggagatggggtttcaccatgttggccaggctggtctcaaactccctacctcagaccacggtgtgaacacatgaacagaagacgaaaatttcttctagcctcagtacttgctctccagaattcaagttttatatatccatcatgtcagaagtgcttctctaggataatcctggtctccaaaaggtctaattgtccaaaatgtggctctactggtgaatctggaaatgccaattacagatacaaactttccttaaaagttgcagaatcaaacaaattgtttgttattactgtatttggaagttgcttagatacattttttggtcttactgccactggtttgcacaggtacattcaggatcctaataaaattccagaaacactggacaatgatacaactcagaatctattaactaaagcagttgaaacttgctttgttggacaaagctttatttttggagtgacgaattttgaaaaccaacctggacaaggttcagatgccagtaacttcttacagcaatgctctgaccacaaaagaaaagccaaagcactagtggcttgccagattgttctaccagacccaggtattgcaggctttactgtcattgactacttccatcaacttttgcagacttttaatttcaggaaacttcagtgtgactctcaggcacctaacaatcacttacttgctttagatcactcaaatagtgatctcagcagcatatatacttctgacagcacttctgattttttcaagtcctgcagcaaggatactttttcaaaattctggcagccatcacttgaattcacttgcattgtttcacaactaacagataatgatgatttttcagcttcagaacaaagtaaggcctttggtactcttcagcagaacagaaagtccatctccattgcagaggccactggttccagtagctgccatgatcccattcaggattcatggagccttgtttcatatatggataaaaagagtacagcagaaaagttgggtaaagaacttggcttacaagctaaggagctgagtgcagttcacagcagtcatcatgaaattggagttaatgactctaatttattctctttggaaatgcgagagccccttgagtcaagtaatacaaaatccttccacagtgcagtggaaattaaaaataggtcccagcatgagctaccatgttttcagcatcatggtatagataccccaactagccttcagaagagatctgcatgttgtccaccttcgttactcagacttgaagagacagccagcagttcccaggatggtgaccctcaaatttgggatgatctgccattctctgaaagcctgaacaagtttctggcagttcttgaaagtgagattgctgtaacccaggcagatgtcagtagtaggaaacatcatgtagataatgacattgataaatttcatgcagaccacagcaggttatctgtgactccccagagaactactggagccctgcatacaccacctatagctttaagatcatcacaagtaatagtcaaagcaaactgtagcaaagatgacttccttttcaactgtaaaggaaatctaagtcctagtgttgaaaaggagtcacaaccagataacaaagtagaggctgtctctgtaaatcataatggaagagatatgtcagaatattttttaccgaatccttacctgtcagctctgtcttcatcttcaaaagatttagaaacaatagttactcttaagaagactatcagaatctcaccacacagggagagtgaccattctagtctaaataacaaatatttgaatggatgtggagaaatatcagtttcagaaatgaatgaaaagttgacaactctgtgttataggaagtataatgatgtctctgatctttgcaaattagaaaataaacaatattgtaggtggtccaagaaccaagatgacagttttacaatttgcaggaaacttacatatcctttagaaactctttgcaatagtccaaatagaagtacaaatacattgaaagaaatgccttggggacatatcaataacaacgtaacacagagctattctattggttatgaaggtagctatgatgcctctgctgatctctttgatgatattgctaaagaaatggacattgcaactgagattaccaaaaaatcacaggatattttgttaaaatggggaacatctttggcagaaagtcacccttcagagtctgatttttcactgagatcactttctgaagacttcatccagccttcacaaaaattatccttgcaaagcctatctgactctaggcattcaagaacatgctctccaacacctcattttcaatcagattcagaatataattttgaaaatagtcaagactttgttccatgttcacagtcaactccaatttcagggttccaccaaacaagaattcatgggataaacagagctttcaaaaaacctgtattttattcagatcttgatggtaactatgaaaaaataaggattttccctgaaaatgacaaacagcaagccagcccaagctgtccaaaaaatataaaaacacctagccagaaaatcagaagccctattgtatctggtgtttcacaaccagacgttttcaatcactacccttttgctgagtgccatgaaactgatagtgatgaatgggtccctcctaccacacaaaaaatatttccttcagatatgcttggattccaaggcataggtctagggaaatgccttgctgcctatcatttccctgatcaacaagagttaccaagaaagaaactgaaacatattagacaaggaaccaataaaggtttaattaagaagaaattaaagaatatgcttgcagcagttgttacgaaaaagaaaactcataaatataactgtaaaagttcaggctggatttccaaatgtccagacattcaagtcttagcagcacctcagctgcaccctattcttggacctgattcttgttcagaagtcaaatgttgccttccattttcagaaaaaggcccaccttcagtgtgtgaaactcgaagtgcttggtcacctgaattgttttcataa

SEQ ID NO: 3099 - DNA, 1579 bp, Homo sapiens
ggccgggagttccccaagaccggaagtgtcccgaggccgggagcccgcgggaccccggagcgcgcggggccggaagaggcgggcggccagtggaggtccgcagagtttgggcgccaggcgagacggcagggcttaaagttccgggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaaggtgcgacagctctggtcagaagactcctgcgaatctggcaaactccctgcgacaaggactgtgtactgcatgaatgaggctgagatagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggt

SEQ ID NO: 3100 - DNA, 1676 bp, Homo sapiens
ctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttggcagcagtgggagtagtggagggagccacccaagtagtcggagcagcagtcgagagaacagtggaagtggtagtgtgggggttcctattgctgttcctactccatctcctcccagtgtctttccagcccctgctggctctgctggcactcctccccttcctgctacttctgcatctgcccctgctcctcttgttcctgctactgtcccttcctccactgccccagacgctgctgctgggggtgcccagacccttgctgatggcttcacttctccaactccccctgttgtttcttccactccccctacaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaa

SEQ ID NO: 3101 - DNA, 8769 bp, Homo sapiens
taaagatatatccagaagaaatcactccactcctaccagccatatcaggggagaagattgctgaggaccaaacctgcttttttcttcaaatactgttgaagtatatggttattcaggctgcgagcttggagtggaagaataaggagaatcaagatactggttttaaatttctttttacattgtttcgaaagtattatcttcctcatttatttccatcatttactaagttaacaaacatctacaaacctgtacttgacatcccccatttgagaccaaagcctgtgtacattactaccactcgagacaatgagaacatttacagtacaaagattccatatatggcagctcgtgttgtttttattaagtggattgtaaccttctttttggaaaaaaagtatctaactgcaacacaaaacactaaaaatggagttgatgtattgcctaaaatcatccagactgttggtggtggtgctgtgcaggagagagcgcctgagctggatggtggtgggcccacggagcaggacaaaagccattctaacagcagcaccttgtcggaccgaagactcagcaactccagcctctgtagcattgaagaagagcaccgaatggtgtatgaaatggtacagcggattctcttgtcaacacgaggttatgtcaacttcgtgaatgaagtatttcaccaggcatttttgttgccttcctgtgagatagctgtaacaagaaaagtagttcaagtgtacagaaagtggattctccaggacaaacctgtgttcatggaggagccagatagaaaagatgttgcccaagaagatgctgaaaaattaggattttccgagactgatagcaaggaggcctcatctgaaagttctggtcataaacgatcttccagttggggacgcacatactccttcacaagtgcaatgagcagagggtgtgtgacagaggaggaaaatacaaatgtgaaagccggcgtccaggctttgttgcaggtatttttgacgaactctgcaaacatctttttgttggaaccatgtgctgaagttcctgtgctcttgaaagaacaagttgatgcttgtaaagctgttttgattatttttaggcgcatgataatggagcttacaatgaataaaaagacatgggaacagatgttgcaaatactactcaggataacagaagctgtcatgcagaagccaaaggataaacaaataaaggacttgtttgcccagagcttggcagggttactatttaggacgctcatggtagcttggatccgagcaaacctctgtgtgtacatttctcgagagctctgggatgactttcttggtgtgctgtcctccctcacggaatgggaggaacttataaacgagtgggccaacattatggactccttgacagcagtgcttgcaagaaccgtttatggagttgagatgacaaacctacctctggataaattaagtgaacaaaaggaaaagaagcaacgaggcaaaggctgtgttctagatcctcagaaaggaaccaccgtggggaggtccttttctctcagctggcggagccacccagatgtgaccgaaccgatgcgatttaggagtgccaccacgtctggagcaccgggagtggaaaaggcaagaaatattgttcgccaaaaagcaactgaagtggaggagtgtcaacagtcagaaaatgcacctgcagccggatctggccatctcacagtgggacagcagcagcaggtccttcggagcagcagcacctccgacatccccgagccgctgtgctcagattcttctcagggtcaaaaggcagaaaacacacagaattcgagttcttcagagcctcagcctattcaagagaataaaggacatgtgaagagagaacatgaaggaataacaatcttagttcgaagaagcagcagccctgctgaattggatttgaaagatgatttgcagcagacacaaggaaaatgtagggaaagacagaagagtgaaagtaccaacagtgacacaactctgggctgtaccaatgaggcagagctgtccatgggcccatggcagacctgtgaggaagacccagaactgaatactcccacagatgttgtggctgatgctgatgcccgtcattggttacaactgagtcccaccgatgcttcaaatttaacagatagcagcgagtgcctcacagatgactgtagtataatcgccggggggagcctcactggttggcacccagactctgctgctgtgttatggcgaagggtcttggggatcctcggagatgtgaataacatccagtcacccaagatccatgccagagttttctgctatctctatgaactctggtacaaactagcaaagatacgggataatctagcaataagcctggataaccagtcttctccatctcctccagttttgatcccaccactcagaatgtttgcatcatggctgtttaaggcggcgacactgccaaatgaatataaggaaggcaaactacaagcctacaggctgatctgtgccatgatgaccagacgccaggacgttctgccaaactcagatttcctggtgcatttttaccttgtgatgcacctgggattaaccagcgaggatcaggatatcttaaatacgatcataaggcactgtccaccccgctttttctccctgggttttcctggcttctcaatgctggtgggggacttcatcacggccgctgccagggtccttagcacagacattttgacggcgcctcgttcagaggctgtcactgtcctcggctctctggtctgctttccaaatacctaccaggagattcctttactgcagtcagtgccagaagtaaatgaggccattacaggaactgaagatgtcaagcattacctcataaatattttactgaagaatgccacagaagaaccaaatgaatatgcaagatgcattgctgtttgctcccttggggtctggatatgtgaagagcttgcacagtgtacaagccaccctcaggtgaaagaggccatcaatgtgataggagtaactctgaagtttcccaacaaaatcgtggcccaggtagcttgcgatgtccttcagttgctggtttcctactgggagaagcttcagatgtttgaaacctctctgcctcggaaaatggcagaaatcctcgtggccacagttgcttttcttttaccaagtgcagagtactcctcagtggaaacagacaagaagtttattgtgtccttgctactctgcctcttggactggtgcatggcattgcccgtgagtgtccttctccaccccgtgtccacagcagtcctagaggagcagcattcggccagagcccccttgctggattatatctacagggttttgcactgctgtgtgtgtggctcaagcacgtacacccaacagagtcactacatactgaccctggctgacttgtcatccacggattatgaccccttcctgccactggcaaatgtgaagagctctgagccagtccagtatcattcatcagcagaattgggtaacctgctgactgttgaagaggagaagaagagaagaagtttggagttgatccctttgactgctcgaatggtgatggcccacctggtgaaccacctggggcactaccccctcagtgggggccctgccatactgcacagccttgtcagcgagaaccatgacaatgcccatgtggaaggctccgagctgtcctttgaggtgttcagaagtccaaacctgcagctgtttgtatttaatgatagcaccctcatctcctaccttcagacacccacagaaggaccggtagggggatcaccagtgggctctctctctgatgtgagagtaattgtgagggatatctcagggaagtactcttgggatggtaaggttttatatggacctttggaaggctgcttagcacccaatggaagaaatccttcatttctgatttcgagctggcatcgtgacacatttggacctcagaaagactcttctcaagttgaggagggggatgatgttcttgacaaattacttgaaaacattggccatacaagtcctgaatgccttttaccgtcacagctaaatctaaatgaaccttccctaaccccatgtggcatgaactatgaccaagagaaggaaatcattgaggtcattttgcgccaaaatgctcaagaggatgagtatatccagagtcataacttcgattctgcaatgaaagtcaccagccaagggcagccctccccagtggagccccgaggacccttttatttctgcaggttattgcttgatgacttgggaatgaattcttgggacagaaggaagaattttcatctattgaagaaaaattcaaaattattgagagagctgaaaaatttggactcccgccagtgccgtgagacacacaaaatcgcagtgttttacattgctgaaggtcaagaagacaagtgttcaatcctctctaatgaaagaggaagccaagcatatgaagactttgttgctggacttggatgggaggtggatctctccacccactgtgggttcatgggtggccttcagcgcaatggcagcaccgggcagacggccccttactatgctacctcaactgtggaagtgattttccatgtttccactcgaatgccgtcagactcagatgattccctcaccaaaaagcttcgtcacttggggaatgacgaggtccatatcgtctggtctgaacactccagagactaccgcaggggtattatcccaactgcctttggagatgtttcaatcattatttacccaatgaagaatcacatgttcttcatcgcgataacgaagaaacctgaggttccattttttgggcctctgtttgatggagccatagtgagtgggaagctgctgccaagccttgtatgtgccacgtgcatcaacgccagcagggctgtgaagtgcctcatcccactctaccagagcttctatgaagagcgagctctgtatctcgaagcaataattcagaaccaccgcgaagtaatgacattcgaggatttcgcagcccaagtcttttctccctctcccagctactccctcagcggaacgggggccctggcctccagtctgagtgctgacctcgaagagcccctgagtgaggaggagacagaacaccctctcctgcctctgccccgagccactaaacccagaatctccaggaaatttcgttgctgtactagtgccctcagcaggtcttcccattagtggacttctgaagcccatggtgaatcccactaccgtgtctcagatgggactcaaactaggctgtatcatcttgtcctgaaacctcacaaaccttggacttccaaagaagaaaagaaaaagtcaccaaaaaccagagatgaacccactgacacgtgggcactggtgtggctgctctgggcagatgacagcaggaaaagattctgcgctttcagggagggggcagagggcagcttgcttctgcaccccaagttgtttcttctcatttatgaacccaagcatgattcacaaaggggctggcaaaacaattgtctaattgaggaatctgatctgcattgattttgctagttccttttatgttaggatttatggtttactcaaaaatttcatcatcatggaaattggctttccccggggtcttttgcccaggagaagttttacctcagttgtccagtgttttcccacatggtacctgacgcccgctaactaagcagaggctctcctcaccacgcagaggcgcttcaggtcatgacagtgatgcccctatcttagaacactcagaagattccagaaatacagggtcctgtccttgcataagttcctgcaggacaggaagtgtcccaaggctcaaaacaacacagaccacatccacacaaaaggcgcatgccggcttcaggcgctaggctgagacgggtaccccccgaatggccttgtgcctccaaaagcctcacgctgcaactttgctgctcctgtctgttgcccagagaggcctcacacaggcctcagaaatgtttcttgtcacacaaagcttttggtagccgattccaagcgagggatttaatccttacatttttgcccatttggctccaaggaaggcttattagacctgtttttttgttgttgttgtttttttttcttaaaaacaaaatgaatgaatgaatgaaaagagaagcaatggtgagccctctcctgctggggcgccctgggtgggccttgcccgtcctgcagcagagaaatcagtcagcagcgaagagctgctggcgcaggccccaggctgtgtcctggacccttgacctgcctcagagctagaggtttgctccaccccgcacttcacttgggaagtaaatccaagaagcttaccagagtccatcgccactgcgcaggctttgttctcacagcggccaggtacagagcaacgccctgcagtgggaagggacagcagcacgagagacgcagcccctaactcagggcttatgatgggtgggctggtcctgggaaaggcgggccctgtgcgggaggcctccccaccttcctgtgccctctgccctctgcccttgcacacacttgttaccttcaggctgcttggccacccaggcctgaagaagccttctgaggctctcaccccatcagaacggccattttcactgaggagccagttttttccatttgccatggagctggtttggctggaacctggcctttgtagggaaaacggggagactcaggagccagactcactcttgggacaaatgagaaagagctgagccagtcgttcctgtcggaagggcgggcctgctcatcctggcgagaatttgcttttctgctttataggggattgcaggccaggcccactgacaggagcaccttgagaaccacctgaacagaagagaatgagggtgccccaaagtggaaggaagcttctggcccctgggccgttttgggaagggcccaggatactcacgggggctgaagggcaatgtgaagagtgactgcaagtcctggcattttctgtggtgtcagcaaatgcccctttattttaaatgattccagacatctgggcagcatagcttggccaccatcactcaggcttgatcctgctgttgagctgctcctgtctcctgtttacctcactcctgttgggaaggccatcgcatgctcctaggctccagagtcccctgtaggtctctaccagcaggtcgcctctgggagaacgtttcatcttcaggctctagaaactcctgttgcggaattgctggctttagtagaaaagatatgtcaggatttagaaatcgtattgaactctcctggacttctgctccatgatttcattttgctttcacgaaccagcgatccctaccttggggtgggaaattcaattgtaggcagcaaataactcaaccctcctgtaacccctgaggattataacgaccccatgacccccgatgacagccagcagtttggtgactagagttttttgagcctgccattctcagtagcagctttggtctggagatggaacgtggagcagggaatctgacagccacgtttctcgtgatcacgtggactggagttgtttttgttatctggggtggaaaattgcaatgatcaagtttcttttttattttttttttacttagaaaagcaaatattgtgtttttgtaataaatccctttcagcaaaattgcggaggatcattcatccactagggccccacctgaggcacagcgctgactcatcacggtggtaccagtaggtcagccatctggaaacagaagtggccctaattgggccaaaatgtggtaagactcgctggcctcaggcagggccaggccagttccctcacttctctgcacacctattcccagattccatccagagcaaagctgatgtttatcgtctcattgtacttaggctttcgtactttaaaaaattatgactttttaaaaataagccttcagcagacagaagtgaagaaatttagcctgggttgcctcagcaacaaagtctgcggttcctaagagccacatgttggggaagtggggtgacccaaacttggtgacataggttgattgatcagaccctcagccttacaagcaagagctcatgcagatccacagagccatgcacatcctgtcttcctgaccttcctcaggtggcaccacctgcgccccatggacctgctgtatcggtgtcatgtggaggtctgatgaatcctttaaaacctaactgtgatgtcgtaaatgtaactgtgctacctttatatctactgaagggcagcgtctgcatccgagggaaattcaacatgaaacaaccatcgttttagttgcactcagtctgtccatatgacatacacatgaagtgaatgtttccttatgttttcaggtctacaatgtttagtacatgtaaataaggaaaaaatttgataaatatggtaaattaagttatagcgtgtcatttgattcttattttgctgtctcttgttatttaattttcctaatgctccacatctaggttccttcctaggtggtgggaacaccttgcagacgtgtgtgcaccaggacacaccgcggcccaggcagccacaccgagaaagcacacatctccactgatggcagccacccgactctccagttaacctcttttactctttaattctgatttactgtgatgatttaataaagtggaaacacagcacttcagtgctatatgtttctctcattctcattatagtttataagaaaataaagttcaccctggcatctaataaaaa

SEQ ID NO: 3102 - DNA, 2234 bp, Homo sapiens
acacttcaaatcctgagcggctgactgtcaggggtgcgtcaggcctgcttgctgggagaatggacgagctggttgtggagcgggcgggtcccgccacccgtgggctcagcactggactgctcccagaacattaaaggtctggctgatgttccatgccacatctggacatgaagacccatgtctgcccttctgtagaagggccaaagaagaaaggaggcatcacatgtttctgctgtggggggcccttccgagcagcagacaggagcaagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctc

SEQ ID NO: 3103 - DNA, 184 bp, Homo sapiens
cgagaacccgctggtttattgcgacgggcacggctgcagcgtcgcggtgcatcaagcttgctatggcattgttcaagtacccactggaccgtggttttgcaggaaatgtgaatctcaggagagagcagccagagtggttgggcccatgtggtttgtgccctgtatattccagaggtacaatttg

SEQ ID NO: 3104 - DNA, 2623 bp, Homo sapiens
cttctcctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgggctgtgcggagacacctgttcccccagcactcagcccctggccgaggtgtcgtctgggagtggctgagcgacgatggctcctggactgcctatgaagccagcgtctgtgactatctggagcagcaggtggccaggggcaaccagctcgtggacttggcccccctggggtacaactacactgtcaactacaccacccacacgcagaccaacaagacttccagcttctgccgcagcgtgcggcgccaagcagggccgccttacccggtgaccaccatcatcgctccgccgggccacacaggcgtcgcctgctcttgccaccagtgcctcagtggcagcagaactggccccgtgtcaggccgctaccgccactccatgaccaacctccctgcataccccgtcccccagcaccccccacacaggaccgcttctgtgtttgggacccaccaggcctttgcaccgtacaacaaaccctcactctccggggcccggtctgcgcccaggctgaacaccaccaacgcctggggcgcagctcctccttccctggggagccagcccctctaccgctccagcctctcccacctgggaccgcagcacctgcccccaggatcctccacctccggtgcagtcagtgcctccctccccagcggtccctcaagcagcccagggagcgtccctgccactgtgcccatgcagatgccaaagcccagcagagtccagcaggcgctcgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaaggagcgaccccgaagccagagccagagccagagcaggtcataaaaaactacacggaagagctgaaagtgcccccagatgaggactgcatcatctgcatggagaagctgtccacagcgtctggatacagcgatgtgactgacagcaaggcaatcgggtccctagctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggtatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagccaaa

SEQ ID NO: 3105 - DNA, 1879 bp, Homo sapiens
agatcctgtgctgggcctcccaactggtgcatggacaggctgaggaagcacaggccgggcagagccctggccaagaggggcgtcttgcgcccacactcacttggcaagtttctgcagcacctgctcgcactccagctgcttccgctcaagctgctcagcatagggcactgtccatagaggggtcaccacgtcggccactcgtgttactggtggctcactctcaccctcctgtcgcctcctcctggccatggggtcggccttgggccgggccaggcgcacactgagtgggcggcctttccagagggcaccatgcaaaacgcgcagggccttgtccctctctgcagcgctgcggaatgtcacaaaggcgcagggtggttgcccaaagagtttggttttgtggggctgcagaccaaagcggcccaggaagcgccggacgtcgctgaagctggcgtggcgaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacaacgtgcctctgaactcagagcaggcccgcagcgaagcttagagcacacgggggtgtggagtcagccagacgggccctgatgggaggacgcagcgcccaggctgggctcgggacgaggatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaaggtgacgtggtgccatgggttggggggcttctttgcagactcactctgcatctgactatacttccaggcgggtgctttttctgtctgccagataaacattccagggtgctgtggccgcctcacgtatccagagtgatgcagctccctggggacacaggtgcttcctggggagccctgagcacttgtcagtgttgctggcctcagtccaattgggcaggcattggagtccgggcactgcctggagctcaccagaaggtgctttatgatggtcctcggtttgtctctcagagggcttggtcacctctgccatgaggctggactgcagctgtggtggcaagtgaccagatgtcactgagcagcctgaccatggtctaggcagtgcttgagtgcatccacctggcttcctttcgtcactgaatttcaagaagacagactccaggaggcggcttggccaggcaggagtctgtcccgagggcgggcaagccgctgtgggtgggtgacggcacttgggaccagcctggcgagggccatgtgcttgaatgcaccgtgcttctgttttctcactgtgctgcttgtgtttttagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactc

SEQ ID NO: 3106 - DNA, 488 bp, Homo sapiens
atgaagagaccgggcgcagcgcgacccgggaagctccgccgaggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcg

SEQ ID NO: 3107 - DNA, 623 bp, Homo sapiens
ggagttgccgggggtcggtctttccgcaggagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggaggttgtcgggacatttcactctccagtaaatgtggcccttggcgttactgagtcctaagaggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatca

SEQ ID NO: 3108 - DNA, 2097 bp, Homo sapiens
gccttggggacatttagggcagagcctcgagtgacaggtcctgggacagtgggagccaagggcaagtgctagagttgcagtgaatttagagcaaagcctcagctaagtgacacatcccagggcagtaggggatctatctaggttcgtgctgggcctcaggtaagtgacaggccttaggacaatgggggctgtggcatgcgtcaggttacctgccttgatatgggatcgtgacaggcccctccctatgtgcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcctgctgtggaggtgcctcaatatgtgggcatccggctcctggtagagggcttcaccatcaagaagcccatggcgatgtgtcatcggcggatgggggtccgcccagcagtccctctgctgacccagcgaggctctggggaagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactg

SEQ ID NO: 3109 - DNA, 965 bp, Homo sapiens
agccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagaggatcaactaaaccttgaactaagaagaaaaatgtgttgtgagcagggggagcctcagctgcctcaggccgttcaggacagaagggtgtttctgaaggccggagcaagttttgaagaagtccctatcagattacacttggttgactactccggagcagccactaagagggatgaacaggcctgcgtggaaattgaatgagattcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgaga

SEQ ID NO: 3110 - DNA, 1667 bp, Homo sapiens
atggccaagtggggccaggggaacccccactggatcgtggaggagcgggaggacgggaccaacgtgaacaactggcgctggcggacagagcgggatgccaccagcttgtccaaagggaagttccaggagctcctggtgggcatcgttgtggagaatgacgctggccgcggcgagatcaacgagttgaagcaggtggaaggggaggcttcgtgcagcagccgcaaaggaaagctgattttcttctatgagtggaacatcaaactgggctggaaaggcatcgttaaagaatctggagtgaagcacaagggattgattgaaatacccaatctttctgaggaaaatgaagtagatgacactgaggtatcgttgagtaaaaagaaaggagatggggttatactgaaggatcttatgaaaactgcaggcactgccaaggtcagggaggcccttggagattacctgaaggcacttaagacggaatttacaacgggaatgattttaccaacgaaagctatggcaacccaggaattgactgtcaaaagaaaactgagtgggaataccctgcaggttcaggcctcatctccagtggcactgggtgtaaggattcccactgtggctcttcacatgatggaactgtttgacacaactgtagagcagctgtatagcatcttcactgtaaaggagttaacaaataagaagatcatcatgaaatggagatgtgggaactggccagaagaacactatgccatggttgcactgaattttgtgcctactctagggcaaacagaattacaattgaaggagttcctatctatctgtaaagaagagaacatgaaattctgttggcagaagcagcattttgaagaaataaaaggttcactgcagctgacccccctaaatggttgaattaaaatttattataaggcattactttttgtaagcggaaaaagtgtcacatttacctcttccctatcttttgtttaaaaggactgtctttattttatattggatgaaatctatgaacatatatacaatgtaaagcattgtttgactctttattataactagacactgcattgatttaaaagtagcaaacaacctgaaattaagtattaacctgaccttccatcgatattcctctggaaataggtaagtcctgagtgcagatagttgatgtttcccaagctgaagcttgtcctatagcaagcttgcttgcagctgtacttttagttcaagatgacaaaaaataaatggcatgttgacactattcctttattttactttagggtttttaaggtgtgtagatcttaggtcgtaaaacagtggtatattgcattcaaaagcatgttgaggtgagggcaaattggctgtgttttgctccacatctccctgcacatctccctgctgtggttttgcacttcggtgtggagaggattgagaagtctgtggggacacattagttctgtggactgctggtaacacttccagtgaaacagcatataatggataaatgtttcccccctctttcacggttttctcactactttcacctgagaagactgaagcaacgtatgtaaacaaatgaaaagtcatcacaatcagtttaattaagtgcacagaatagcaatcaatcaatcagtcatgtcaataaaaataaaacaattattttt

SEQ ID NO: 3111 - DNA, 1591 bp, Homo sapiens
agcatttccggcagccatccccgcggtgctgacatcccggttgttcttctgtgccgggggtcttcctgctgtcatgaaggacgtaccgggcttcctacagcagagccagaactccgggcccgggcagcccgctgtgtggcaccgtctggaggagctctacacgaagaactttatgaaaactttatcagtgaatttgaacacaggtaaaagcctctcatccgtttttcactttgaaaatgagtgcattgatgctcggcggtgctcaaaggctggtggcttttatttcagggtgaaccctttgtccctcgtggaaatcattcttcatgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgtt

SEQ ID NO: 3112 - DNA, 873 bp, Homo sapiens
aggagacaccgccgcagttgccggtacatcggggatttctggctctttcctcttcgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaacaacatcccagagccagttgtcatcggaatag

SEQ ID NO: 3113 - DNA, 3546 bp, Homo sapiens; identical to SEQ ID NO: 3030

SEQ ID NO: 3114 - DNA, 832 bp, Homo sapiens
ccgcaatcatggtgagtgttggtactgaggaggcctagcagggtgaaggccacggtcgcggccttcacgggttcctcggccgtcctgagtcccaaatcccaagctggagccgttcagctcccctccaccgcttagagatttggggggctctggccccgtccttgcggaccattccgaggggagtccagaggtgaggccgaggaacctccctgactttgcggggcgcgccgctcctgcgtctcctgccagtctcccttccttcttttcggtcaacaattgaaaacaaaacgaggaacagcagaggagctactgtataccgagccctcagcattgttcgtaatctccgcctgctaacagccttgtgaagaaggtgctattcttctcaacactttacagatgaggacacttgaggttcggagacgtggagcctcttgcacagctgcttaagtggtagtagagccgagatttgaaccctcctaaccattcctttctgccgcctactgcagctcccagcagagatgattgaactgttgctcggggtagggcccccagggcttgtgctggaaaagatgaaatggggaaaatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtc

SEQ ID NO: 3115 - DNA, 941 bp, Homo sapiens
gagtccctgcttcgcagagcaccggacttggagtcagagagacctggctgcgaatcccggctccgccactttctagcgctgtgaccttggttttcaggtggcgaaactgactggtctggttagagcgcgtccaagccaagccgcagtgctgtttggatttttaaatttctccttctgagtgagaaaatagcaatcgagatggaaccatccgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggcc

SEQ ID NO: 3116 - DNA, 761 bp, Homo sapiens
attcacccagcgcattccgccgcccgcaggcttgcggggaaacttccttattattgtgacgccgaaaacggagaaaccccgggtccggcgagaggggctgtgacagtcggagtcccaagctgcggttcggctgctgccgagaactgcaaggtgtggaatatttctggcttctagtccaatgccaagtgtgtgacctgtgagttaattctgcattttagttttggccctacatttatttaaagcctgaatttggggagtatctgcaaagcactgaaggttttggacattgtcttttcctgctgttgaaagagaccctcttcatatatacaacattcaggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaattggagctctggcagatcagcatatcattcatgtggcatgtggcgagtcccacagtctggccctcagtgaccgaggccagctgttttcttggggtgcagggagtgatggtcagctaggactcatgactactgaggattctgtggcagtgcccaggttaataca

SEQ ID NO: 3117 - DNA, 4288 bp, Homo sapiens
atggaaggggcgctgactgcccgggacaaggtcggggttcaggattttgtgctattggacgcgtacaccagcgaatctgcctttgtcgacaacctccgcaagcgtttcagcgagaacctcatatacacatatattggcaccctccttgtgtctgtgaatccataccaggagctcggaatctacactgtgagccagatggaactttatcaaggggtcaatttctttgaactgccaccacatgtctacgctatagccgacaacgcttaccgaatgatgtgtgctgaactaaataaccatttcatcctcatttctggagagagtggggcagggaaaacagaggcctccaagaaaattctcgagtattttgcagtgacctgcccaatgacccagtcactacaaatagcccgtgacagactgctgttctccaacccagtgctggaggcttttggaaatgccagaacgctccggaatgacaactccagcagatttgggaaatacatggatatacaatttgattttcagggcattcccgtaggtgggcatatcatcagttacttgatagagaagtcccgagttgtctaccaaaacgaaggcgagcggaatttccacatcttctaccagctgctggcaggtggcgaagaggagcgcctgtcttacctgggactcgagcgagacccccagctgtataaatacctctcacagggtcattgtgccaaagagtcatccattagtgacaagaatgactggaaaactgtttccaacgccttttctgtcattgattttactgaagctgacctcgagaatctctttggaattattgccagtgtcttacacctggggaacattggttttgaagaagacgaccaaggctgtgccactatcccagacacccatgagatcaagtggatagccaagctcctgggggtccacccatcagtccttctggaagctctcacccacagaaaaattgaagccaaaactgaggaggtgatctgcccgttgacactagaactctctgtctacgctagagatgcaatggcaaaggctgtttatggacgaacgtttacttggctggtcaacaaaatcaattcctccttagttaacaaggttggtcaacgcattttggatcccttgctcttgctcacgtggaaaactgtaattggattactggacatctatgggtttgaagtctttgacaagaatggttttgaacagttctgtataaattactgcaatgagaaactccagcaactgttaattgagaggactctaaaagcagaacaggcagaatatgaaatggaaggcatagagtgggagccaattaaatatttcaacaacaagatcatctgtgatttggtagaagagagacataaaggaatcatatctattctggatgaagaatgcattcggcctggtcctgctacagacttgagtttcctggagaaattggaagagaaagtgggcaaacatgcacacttcgaaacccgtaagctggctggtccaaagggccgaaagaggattggctggatggagttccgactcctccactatgcaggagaggtcacatactgcaccaagggattcttggaaaaaaacaatgatcttctttacagacatctgaaagaagtgctgtgcaagtccaagaacattatcctgagggaatgcttcctgctggccgagttagaaaaccggaggaggcccccaacagtggggactcagtttaaaaacagtctgagcagccttctagaaaccctcatctctaaggagccctcctacatccgttgcatcaagcccaacgacaggaaagaacccagcaaatttgatgacttcctcataaggcatcagatcaaatacctggggctgatggagcacctgcgggtgagacgggctggttttgcataccgaaggaaatacgagcatttcttgcaaaggtacaagtccttatgcccagacacctggccgcactggcacgggcctccagcagagggcgtggaacggctgatcaagtacatcggctacaaacccgaggaatacaagttaggcaaaaccaaaatattcattcgtttccccagaactctgtttgctaccgaagatgcctttgaatttagtaaacatcaactagttgcaagaatccaagccacttacaaacgctgcctaggaaggagagaatacgtgaaaaaaagacaagcagccatcaaactggaagcccactggcgtggggccctggctcggaaggcaatccaaaggagaaagtgggccgtgcggattatcagaaagttcattaaaggattcatcagtcgcaacaaacccctctgtcctgacaacgaggaatttatcgtgtttgtgcggaagaattacatcttgaatctccggtatcaccttccaaagactgtcctggacaagagctggctgaggcctcctggcatcttggaaaatgcatcagatctgctcaggaaaatgtgcgtgaggaacctggtgcagaagtactgccgcgggatcacagctgagcggaaagcaatgatgcagcaaaaggtagttacaagtgaaatcttcaggggaaggaaagacggctacacagaaagtttaaatcaaccctttgtcaacagtcggatagatgaaggagacattaatccgaaagtgcttcagctaattagccatgagaaaatccagtatggtgtcccggtcattaaatatgacagaaaaggcttcaaagcacggcagcggcaactcattcttactcagaaagcagcttacgtggtggaacttgccaaaatcaagcagaaaatagagtactcagctctcaaaggtgtctccactagcaatctgagtgatggaatcttagtcattcatgtttcaccagaggacagcaagcaaaagggggatgccgttttgcagtgtggacacgtgtttgaagcagttactaaactcgtcatgctggttaagaaggagaacattgtcaatgttgttcaaggaagtttacagttttttattagtccgggaaaagaaggcacaatagttttcgacactggactggaagaacaagtctataaaaataaaaatggacaattaacagtggtgtcagtccggaggaagtcctgatagaggatgacgtctgacctctaccatcgccatttttgctccaactgaggaaactacaggggaagtggggattggatccagttagctacctcttcaaggtaccaggcccgcagcactaacagatcacatctgaagaaactgaggggcgttaggccaaagcctaatcccagctcctcagctgccccatggcaccttatttaaaatgtcaccttctggaagcagaccccaggtcacccgaaggcgcaattctaaacaccctcgacaggatctatgttcagtgcgcagtccaacgtgtcattagagggtgggcaagattctctacctctgtcaagctgccctgagacatgatgaaatactgtgtacagcaagttctcaaataacatttcgttatatgttgataagacatctgattcctgggcagggccactgtctgggtggagtctgtatgttctccccatgtctctgggtttcttctgggtgctctggtttcctcccacgtccccaaggtgtgtgtgtcaggtgcactggcgtgtctatgcggtcccagtctgagtgagtgtgggtgcgtgagccccgtgagaggaggacatcctgtccagggtgggtcccgccttctgccctgagctgctgggattgggctctggccatctgcaaccctgaacgtgcaggttggagaacgaatgaatacaaattttattgtaaaataaaaatgtatataaagcatatgagcacacaaatggacaataaatgccacagcgcaaaagcgtgtagcgagcctgccacgcttgtgactggggaggggctccgtataatctcacctttgcaagcgtttatttactgatgtatgcggccaccactgtgaccaccatcacttaccgattcaccaaaacttaggtaatatggtcttatttttgatttaattaaatatacgtgtagctcatgtatttcacagtttaatatgagaagtgctttggtctttatttagaaattgggtgatgtttttgtgcccagcaacatgctgtaggaatttaactcttgtttacatccattagcctcatggttttgcttcaagtctcagcttccaagaacctatcgatgacttactgtgcatggtctgagactaagtaaaggaaatttcctaaagctgtgaaatttgaattttgctttaaataaatggaactcacatgtg

SEQ ID NO: 3118 - DNA, 1510 bp, Homo sapiens
cgcacccgcgggagcggagccgtggcgcgctcgccccggacgccggccgcccctccgctcgccctactgagcgagcggcccggggcgccgaggggtccgcgccgcgcggggcgcaccgccctggccgccatgtgctcccagctctggttcctgacggaccggcgcatccgcgaggactacccgcaggtgcagatcctgcgcgccctccggcagcgctgctccgagcaggacgtgcgcttccgggcggtgcttatggaccagatcgccgtcaccatcgtcggcggccacctcggcctccagctaaaccagaaggccctcaccactttcccggatgtggtgcttgtacgggtacccacaccctcagtgcagtcagacagtgacatcactgtcctgcgacacctggagaagctgggctgccggttggtcaatcgcccacagagcatcttaaattgcatcaacaaattctggacgttccaagaactggctggacatggggtccccatgccagacaccttctcctatggtgggcatgaagacttttcaaaaatgattgatgaagctgagcccctgggctacccagtcgtggtgaagagcacacgaggccaccggggaaaagctgtttttctggcaagagataaacatcacctctctgacatctgccatctgatccgccacgatgtgccctacctgttccagaagtacgtgaaggagtcccatggaaaggacatccgggtggtggtggtagggggccaggtcataggctctatgcttcgctgctccactgatggacggatgcagagcaactgctctctcggtggcgtgggcgtcaagtgtccgctgacagaacaaggcaagcagttggctattcaggtgtccaacatcctaggcatggacttctgtggcattgatctccttatcatggacgatggctcctttgtggtgtgtgaggcaaatgctaatgttggcttcctagcctttgaccaggcatgcaacttagatgtgggtgggatcattgcagactataccatgtccttgctgccaaataggcagactggaaagatggctgtcctcccaggactgtcgagtccaagggagaagaacgagccggatggctgtgcttcagctcagggagttgcagagagcgtctataccatcaacagtgggtctacctctagtgaaagtgagcctgaactgggagagatccgggattcctcagcaagcacaatgggggccccaccctccatgctgcccgaacctggctacaacattaacaacaggattgcttctgagttaaaacttaagtgaattcctgctttttggcagcatttaaaccaaatcctactgcttccctagtagttttgagtgaataaaatctggactaatgtgatttcatttgcacagaaactagaaatcccatctgggcactcagcattttttctaacgatgatttaagcaaatggcctagctttgtggtttttacaaagacaaatataaaaacactcaagaacaa

SEQ ID NO: 3119 - DNA, 1783 bp, Homo sapiens
aactcctaactgcagcggaaacgtgggagccgcgcgggccgctgtcgtcccaacccccgccgccctcgtcgcgcgcggggcctccgcgcccccggctgctgctcacgccccgcccgggagccaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgcttctcttgcctcttgctgcaagaatgtctgaggagtcttactttgaatctaaaacagaggagtcaaacagtgcagagatgtcatgtcagatcacagcaacaagtaacggggagggccatggcatgaacccaagtctgcaggccatgatgctgatgggctttggggatatcttctcaatgaacaaagcaggagctgtgatgcattctgggatgcagataaacatgcaagccaagcagaattcttccaaaaccacatctaagagaagggggaagaaagtcaacatggctctggggttcagtgattttgacttgtcagaaggtgacgatgatgatgatgatgacggtgaggaggaggataatgacatggataatagtgaatgaaagcagaaagcaaagtaataaaatcacaaatgtttggaaaacacaaaagtaacttgtttatctcagtctgtacaaaaacagtaaggaggcagaaagccaagcactgcatttttaggccaatcacatttacatgaccgtaatttcttatcaattctacttttatttttgcttacagaaaaacggggggagaattaagccaaagaagtatatttatgaatcagcaaatgtggtgcctgattatagaaatttgtgatcctatatacaatataggacttttaaagttgtgacattctggctttttcttttaatgaatactttttagtttgtatttgactttatttcctttattcaaatcatttttaaaaacttacattttgaacaaacactcttaactcctaattgttctttgacacgtagtaattctgtgacatactttttttttcttatagc

SEQ ID NO: 3120 - DNA, 2308 bp, Homo sapiens
agtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggtcttaacgcccctgaggctgagccctgctgcagaacccagcgctcctggccttgggccagcagctgaagccccatgctgtgtggagcaaagaggtttcctgagcaggcacatcccccggtccttctctgcattccaggcagctccaccaaagtctgcgtgcaacgcccttcatttgcatggacacacgcaaccctcggcgtttgtatggtcattaacatgctcctcccaccacggaagaactttcgaggcccgtaccaaagtagatcctttattcaaaatctgtgggggttttttgactgtttttgctgacctgtgacctctcactgaggacggcagtccaggaccacccccagaggggttcaaagacctccgaaaccagagaccacccccacatacaggtccatggagagggcctggaccatctggacccccacggtcaggccaagtcccagataatagcaccagatgtttcctgtccgacttttggtctccccaaggcgaccagaggccgagctgcccctacacaggcgc

SEQ ID NO: 3121 - DNA, 955 bp, Homo sapiens
ccgagctcggagccccgcgggccgcgcccgccgccggccccacccatccgggtcgaggaggccgaggccatggctgagacggaggagcggagcctggacaacttctttgccaagagggacaagaagaagaagaaggagcggagcaaccgggcggcgagtgccgcgggcgcagcgggcagcgccggcggaagcagtggagccgcgggtgcggcgggcggcggggcgggcgcggggacccggccgggtgacggcgggaccgccagcgcgggggctgcgggcccaggggccgccaccaaggctgtgacgaaggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaacaggtacttaaaatgaatgctacctggaattaaatgactacatatggcacatctacatcttactttagggacatgaattttttaaaataaataaaatgggaagaaatgtaaatgacatcagatggaaatgtgttttttggggtggcttttagaataaatcccagccttttcaccactttgagagcacagctggcttgaatttaaacctccacgtggacttgctcctctgctctgtcttaaaaaatgtgtaagggaccttg

SEQ ID NO: 3122 - DNA, 4747 bp, Homo sapiens
atttcctcttaatctgattgcagcttgaaggcagcccatttccattaagtaggactgcatggcaagcagccccaccaaagggttgacaatgagcgtcccagtggctcctaagaaatcatgttacactcagttgcgggacaacagaaatgcagcaagaaataataatgaaagcatcttaagtctgggagatacgaatgccaatcaaatcatgttggaggtcagctcctctcatgacgagtccaagacatgtgacctgggagatgaaattggaaatacaaattcaagtgagccagaaaaccgtacccatttccataaggaatttcaccaacttcagggctttgggaaaggctctcaggctggctctgccagcctgaaagattttagactttcttcaaccattcagagggaactcaatgaagagcacacagtggagagaggcacagatagcctgcagaccacgcggagtattcagggaccaagtctgtcgagttggaggaatgtgatgagtgaggccagtctagacgttttggctaaaagggatgctgaaattccccggcatgttcccaaggataaactggcaaagacccttgacaatgaggaactgaggaggcattctttggaaagagcaagcagctctgtagctgcagtcgggagcctgactccgcagcatccacagcctctatccctcgactcccgggaagcacggggtcagatacctgggggtggggaggggccacagaagacattgccagaccacgctgtcccggcagctttccctgcaactgacagtacctcagagggaaagagtgtgcgtcatcctaaaccatctacctcagaaagcaagcagagcactccctcagagacccaaacagtgggggcacatgtactgcaggtgtgcagtgagcacacatcacattccgcccatccagagcctgctctgaatttgactttggcatcgaaggaaatcccaagtaaactggaagcacaattaggtcagggaaagggagaggccaagctggatctgaaatatgttcctcccaggagagttgaacaggagggaaaggcagcccaggaagggtatctgggatgccacaaggaagagaatctgtcagccttggagggaagggatccatgtggggaagcacacccggaagccaccgatgcacttggccatctgctgaacagtgacctccaccaccttggggtgggaagaggcaactgtgaagagaagagaggagtcaacccaggggagcaggattctctccacaccacccccaaacagggctctgcttccttaggaggggctgataatcagcccactggcaaaatttcaccatgtgcaggtgagaagttgggtgaaaggacatccagcagcttttcaccaggtgacagtcatgtggcttttattcctaataatctgactgacagcaagcccttggatgtcattgaggaggaaaggcggttgggcagtgggaataaggacagtgttatggttttggtgttcaatccttctgttggagagaacaagacggaggtgcctgagcccctggaccctcaaagtggccgctcagaagcacgggaaagcaaagaggtcaccacatctgttgctgaaaacaggaaccttctagagaatgcagataagattgaaagcacctcagcaagagcagattcagttctcaatattccagcacccctccacccagagacaactgtgaacatgacctaccagcctacaacacccagtagcagttttcaggatgttagcgtgttcggtatggatgcggggtcccccttggtagttccaccccctactgatagtgcacgcttgttgaacacgtcccccaaagtgcctgacaagaacacttgccccagtgggatccccaagcctgtcttcacacattccaaggacacaccttcctcgcaggagggaatggagaactatcaggttgaaaaaacagaggagaggacagaaactaagcccatcattatgcccaagcccaagcatgtgaggcccaagatcatcacctacatcaggaggaatccccaggccctgggccaggtggacgcctcgctggttccagtggggcttccatatgccccgcccacatgtaccatgcctcttccccacgaagagaaggcagcaggtggtgacctgaagccatctgccaacctctatgagaaattcaagccagacctgcagaagccaagggtcttcagttccggattgatggtgtctggaatcaagcccccgggacatcctttcagtcaaatgagtgaaaagtttttgcaggaggttacagaccaccctggaaaagaagagttttgttctcctccctatgctcattatgaagtccctccaactttctatcggtcagccatgctccttaagccccagctaggattgggtgcaatgtcccgtttaccatctgcaaagagcaggattctgattgcaagtcagaggtcttcagcgagcgccatccacccaccaggacccataacaacagccaccagtctctacagttccgatccttcagcagatttaaagaaagcttccagttcaaatgctgcaaaatccaatctcccgaaatctggtctccgtcctcccggatactcacgtctcccggcagccaaactggcggcatttggctttgtccggagctccagcgtctcctcagtctccagcacccagtccggggacagtgcacagccagagcagggccggccagccacccgttcaacctttgggaatgaagaacagccagttctgaaggcatctctgccttctaaggacacacccaagggggccggccgggtggcccctccagcatcctccagtgtgacagcaccccgcaggagtttacttccagcgccaaaatccacttccacacccgctggaacaaagaaagatgctcagaaagatcaagatacgaataaacctgctgtttcatctcctaagagagtagcagcttcaaccaccaagcttcattcaccaggatacccaaagcagaggactgcggcagctcgaaatgggtttccgcccaagccggacccgcaggcccgtgaggctgagcggcagctggtgctgcggctgaaggagcggtgtgagcagcagaccagacagctgggcgttgcgcaaggggagctgaagagggccatctgcggctttgatgccctcgccgtggccacgcagcatttctttagaaagaatgaaagtgcccttgtgaaagaaaaagagctgtcaatcgaacttgcaaacatcagggatgaagttgccttccatacagcaaagtgcgagaaactacaaaaggagaaggaggagctggagaggcggttcgaggacgaggtgaagaggctgggctggcagcagcaggccgagctccaggagctggaggagcggctgcagctgcaattcgaggcggaaatggcgcgcctgcaggaggagcacggtgaccagctgctgagcatccggtgtcaacaccaggagcaggtggaagatctcaccgccagccatgatgctgctctcctagagatggaaaataaccacacagttgccatcacaatcctgcaggatgaccacgaccacaaagtccaagaattgatgtccactcatgagcttgaaaagaaagaattggaagaaaattttgaaaaactgcggctgtcattgcaggaccaggtggacacgctgaccttccagagccagtctctgcgggacagagcccgccgcttcgaagaggccttgaggaagaacacagaggagcagctggagattgcattggctccttatcagcacttggaagaagacatgaagagtctgaagcaggtattagaaatgaagaatcagcaaatacacgagcaagaaaagaagattcttgagctggaaaagctggcagaaaagaacattatcctagaagaaaagatccaggttctccaacagcagaacgaagacctcaaagcaaggattgaccaaaacacagttgtcaccagacagctgtcggaggaaaatgctaacctccaggaatatgttgagaaggaaacccaggagaagaagagattgagccgaaccaatgaagagctgctttggaagctccaaactggggacccgaccagtccgattaaactctcgcccacatctcccgtttaccgcggctcctcctcggggccctcctctccggccagagtcagcacaacacccagatgacgccactacacggcctgcgggagctccggcttctcgtcctccggtctccaccctgagggagcaccgacccggtgccgccggagctggccctgtgcgcatgctcagtagctgcgaatgcatcctaggcgcgtcctcctctgatccccgtgtaagactgccctggtgtcggcacttaggaatgtgtaaatggtaaagtctgatgtgcaaacgttttaccatagttagagccaaaagaaagacacttgcaattgttcttgagcaatgaactttcactgcagaatttcaggttagttacaaaaagctcagttttcaatatacattgaataatcattgtgtactgcaccgatatgtgtgtatatttagatatacgtatatacacatgctgcggttctgaatttcattttttataacatgaagtgctgacatattttagtgaaggtcagcagttttctaacttgtgcctaagaattattgggaaatgaaaatgcatttctatctagcttcccaggaatatttctacccaaaatagaaaaaggaaaaaaaaaaaga

SEQ ID NO: 3123 - DNA, 1833 bp, Homo sapiens
gttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaagacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattg

SEQ ID NO: 3124 - DNA, 582 bp, Homo sapiens
aacagaccgccgtgagagaggaggggcgccggccgggattcgcggcccggagctcgggaccggagtcaggaatggagagaagggtaatggtgttacctcttattgtggaaacctgttgagatcacagagaatatactgacggcataaaagggcagaaccatagcagggtgcgaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtg

SEQ ID NO: 3125 - DNA, 559 bp, Homo sapiens
ggcgaggaggggaatttccttgtgcctccattcccgggaggggggagcggcgttggaggccaccgtttccagcatcaacaacagcaacttgtgattggcggtgaccggatattcagttgcacatccccacatcaatgcactgccaatgacagcaaaaccaacttctcctcagccttgtgaagaggatgaggaccttcaggatgattcacttccatttaatgaatgggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaac

SEQ ID NO: 3126 - DNA, 3926 bp, Homo sapiens
gcacttccgggccggccgattccgcgcgtctccgcccatcatggcgctcgtgccagtgtcccgtgggctacccactcctgtcatgtcctttgggctggtgcaggccagatcttctagggccgtagccctgagaggagcgcctggagaggaaacggcgcgccatgcacctcacacggcccctcagacctcacggcgaggccctatcagggtaatggtgtccgccggactcgcacaacactccgccggactcgcacaacactccgccgcactcgcacaagactccgccgcggcgacctctactgaaagacccccagtcctggtgtcgcccgaaggcccaggaaaccgtgcttccgcgcttctcccccagaacgtgggaagctgccgctttaccctcattttaccccagggtcgcaaaacatctcaccgtagttgaagccagcaagccggaccaggcgtcccggccaagccacgtgcgcgccccgcgccgcgagtgctcgccccgcccctagggaggagccggccgacccccggccacttagcagtgccgcagccgacggggtgcggttcggcgctcccaggttcctttcctcactgcacgctcttgcccctcctcttttctctcctgcccgtgttcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcagcagcattttgtggctcactacctaagggcccagcaggaggaatacgcagttgagggcctggagtggtcattcatcaactaccaggacaaccagccctgtttggatctcattgagggaagccccatcagcatctgctccctcataaatgaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaaggaccctatcccacctgagctgaccaggctcctgcagcaatcccaggaccccctgctcatggggctgtttcctactaaccccaaagagaagacccaggaggaaccccctggccagagcagggcccctgtgttgaccgtggtgtccaagttcaaggcctcactggagcagcttctgcaggtcctacacagcaccacgccccactacattcgctgcatcaagcccaacagccagggccaggcgcagacctttctccaagaggaggtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtga

SEQ ID NO: 3127 - DNA, 6050 bp, Homo sapiens
cgttcacacctcctttccgagtatctgcatgccttgctggcccagagcacaagacccccattgtgctcccccggctcagaatccaaggaaagaaaggaagcgaagcctctgcattgagttctaggacagctgagacacttggattggacttaatcttaaacctctggagttcaagaccttttaaaaagggctaaataaacaatctctacatgtaaaaggccactgactcctacttcctctgtatagagcaactgttgaactcagctgcctgtagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaaggtggggatgatagcaaaatatgtccatccctttgcagttactcagggctcaacggcaacccctccagtgagttagattactgtagcacttacagacagcacttggatgtccctcgggactcaccaagagccattagtttcaagaacggctggcaaatggcccggcaaaacgcagaaatctggagcagcacggaagaaaccgtctctcccaaaatcaaatcccggagctgtgacgatctcctaaacgacgactgcgatagcttcccggacccgaaagtcaagtcggaaagcatgggctccctgttatgtgaggaggactccaaggagagctgccccatggcgtgggggtccccctacgtcccggaggttcgcagtaacggcagatcaaggatcagacacaggtcagcccgcaacgccccggggttcctgaagatgtacaagaaaatgcaccgcatcaaccgcaaggacctgatgaactccgaggtgatctgctccgtgaagtccaggattctgcagtacgagagcgagcagcagcacaaggacctgctgcgcgcctggagccagtgctccacggaggaggtgccccgggacatggtgcccacacgcatctccgaattcgaaaagctgatccagaagtccaaatccatgccaaatttaggggatgacatgctgtctcccgtaaccctagaaccaccgcaaaatggcctatgtcccaagaggcggttttccattgagtatttgctggaggaagaaaatcaaagcggcccccccgctcggggccggcgaggctgccagtctaacgccctggtgcccattcacattgaagtcaccagcgatgagcagccccgagcacacgtggagttttccgacagcgaccaggacggggttgtgtccgaccacagtgactacattcacctagaggggtcatccttctgcagtgaaagtgactttgatcacttttccttcacatcctccgaaagcttttacggatccagccaccaccaccaccatcaccaccaccaccaccaccgccacctcatcagctcctgcaaaggcaggtgcccggcctcctacactcgatttaccacaatgttaaaacacgaaagagccagacacgaaaacaccgaggagcccagaaggcaagaaatggaccctggcctttctaaacttgcttttctagtcagtcctgtgcctttccggaggaaaaaaaattcggctcctaagaaacagactgaaaaggcaaaatgtaaagcatctgtgtttgaggctctggactctgcccttaaagacatctgtgaccaaattaaagctgaaaagaaaagggggagcttgccggacaacagcatcctgcaccgcctcatcagtgagctgctgccagatgttcccgagaggaactcatccctgagagcgctgaggaggagccccctgcaccagcctctccacccactgcctcccgatggtgctattcattgtccaccctaccagaatgactgcgggagaatgccccgcagtgcctctttccaagacgtggacacagccaacagcagctgccaccaccaagaccgtggcggtgcactccaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatggttcacagtgcctgaattacacctgctccgaaaactagctttgtatttcttatgactttgcataagaactgttcatctttggatcttgagcaccttacagataaaactttttatggcatctctttcatggacagtgatattgatcttttcacaatgtacgtagcctctagaattttgtacatatgtttgctctttttttgtacagactagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtatacttcagtttttcttcttgacatttatctttataaaaattgtgtattttattccaacttgttaaactaagagaaaatgca

SEQ ID NO: 3128 - DNA, 884 bp, Homo sapiens
atcttgagtgagggcacgctctccttagaggggcggaacagtttttggcaccttatcgcgagcggcagcttatgcaagagtgacttaaaaaagaaaggcaggtccggagccaggggctaagtagcggtgcggtttctttttctggattagtttccccatcttgcctaaaaatgtcctagtctagtctttttagcagaactccactccctaaacatgtcagaactacacttcccatcaagggtcagaaagaaacttccggcacagtcttttcccagcattccttgtttacttccgggtttattactactgaaggaagaacgccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaattaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctgg

SEQ ID NO: 3129 - DNA, 694 bp, Homo sapiens
ccgttcccaagctggtttgaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggttcagcttgttggtttagatgaggagagttcagagtttatttgcagaaacacctttgaccacccataccccaccacaaagctcatgtggatccctgacacaaaaggcgtctatccagacctactggcaacaagcggtgactatctccgtgtgtggagggttggtgaaacagagaccaggctggagtgtttgctaaacaataataagaactctgatttctgtgctcccctgacctcctttgactggaatgaggtggatccttatcttttaggtacctcaagcattgatacgacatgctgtttccagtggccagtatgtctttcattgctttgcacccactgttaccagaagctgctctag

SEQ ID NO: 3130 - DNA, 1284 bp, Homo sapiens
cggtaccacagcttctcgtccgcgtcgagattacagccacggccttcaggagtgaccatagacgaatcctttctcacagaagacaagagcacccagaatcgcaagcttcttcagaaacgaaggacgctggtgaccaaactgaggaagaacttggctgaggagtacctgcactacctcagtgagcgagatgcctgtaagatcctcatcgcagacctgaatgagctgcggtaccagcgggaggacatgtcattagcccagtcgccaggcatctggggggaggaccctgtgaagttaaccctggctcttaagatgacccggcaagacctgacccgcacgcagatggaactcaacaacatgaaggccaactttggagatgtggtccccaggagggactttgaaatgcaggagaagaccaacaaggatcttcaggagcagctggacaccctgagagccagctacgaggaggttcgcaaggagcatgagatcctcatgcagctgcacatgagcacgctgaaggaacgggaccaattcttctctgagctgcaggagatccagcgcacttccacgccgcggcctgactggaccaagtgcaaagatgtggtggctgggggcccagagcgctggcagatgctggctgagggcaagaacagcgaccagctggtggacgtgctcctggaagagattggttcggggctgctgcgggagaaagacttcttccctggtctgggctatggggaagccatccctgcttttcttcggtttgatggcctcgtggagaacaagaagccaagcaagaaggacgtggtcaacctcctcaaggatgcctggaaggaacgtcttgctgaggagcagaaagagacgttcccagatttcttcttcaatttcctggagcatcgctttgggcccagtgatgccatggcctgggcttatactatttttgaaaatatcaagatcttccactccaacgaggttatgagtcagttctatgcagtcttgatgggaaagcggagtgagaatgtgtatgtcacccagaaggagacagtagcccagctgctgaaggagatgacaaatgctgacagtcagaacgaggggctactaaccatggagcagttcaacactgtcctcaagagtaccttccctctcaagacagaagagcaaatccaggagctgatggaggcagggggctggcatcccagcagcagcaatgcagacttgctcaactaccgctcactgtttatggaggatgaggagggccagagtgagccctttgtgcaaaaactctgg

SEQ ID NO: 3131 - DNA, 268 bp, Homo sapiens
cggctgcgcgagcggagggaggcggagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgac

SEQ ID NO: 3132 - DNA, 2060 bp, Homo sapiens
gcacagctgcccgccggaagaaccgagcttggctgtgtttatctcgttggggactaaggcgtcggttggcgcgcaacgggttctaggctgcaggcagctcgaggacccgcggccccgccccggctcggcctggcagtcctggcagcataccaggcacagctgtcaaaggaactccttgtgcctgtggggggccctgggtgaccccaatgacaacaactcagcttgacaggagctccctgtgaggggctaaccaaccgcggtaacatggaggtccctgtcctggatcaatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacctcctttcagctgctcctgggcctcagctctgcccagggccagccaggttctgctgggaagggaagggaatggggagaagggagaagcaagcagtgtctgagcctcaggagcttccccctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctccaaacgtg

SEQ ID NO: 3133 - DNA, 3448 bp, Homo sapiens
ggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagctggtggtgtctgtcgattgactgagtgctggagctggcagccctgtgcaggctgccacctttgcccctttactgtgcttgctcctgactctatgtcgcgtctccaaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccaggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacacgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 3134 - DNA, 740 bp, Homo sapiens; identical to SEQ ID NO: 1924

SEQ ID NO: 3135 - DNA, 1893 bp, Homo sapiens
cagggagttgcctgagggaaaaggggcagacgtccctgggttccggtgttcgcggaggagtcgaggcacggagaggcttcgggggagggacggaaagaagggtggcccgccaggcgggcggggtccatggattcggggtgagggccgtccgcggcctcgctttcgcctcctccgagccgggccggcgatggccgcagctgtgaggcgaggtcgggtcccgtagcggcgcgcagcctccttgggggactcggggtcctgcagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaagttcacagaaatcagccaccgcatcctgtgctcatacaacaccaacattgaagagctctttgcagaaatcgatcagtgcttggccataaatcgaagtgttcttcagcagttggaagaaaaatgtggccatgagatcacagaagaggaatgggagaaaatccaagtgcaggctctgcgccgggagacccacgagtgctccatctgcctggcccctctctccgctgctggcggtcagcgcgtgggtgcaggcaggcgttccagagagatggccctcctgtcctgctcacatgtgttccaccatgcgtgtctgctggcactagaggagttctccgtgggagacaggcctcctttccatgcctgtcctctctgccgctcctgctaccagaagaagattcttgaatgttgaattcatagtcaaggaaagttaggtaattctgaggaaaaaagtttaccatcattttggatgaactgcatgagttctgggttaagtactacaatgtaatctgtttcccagggaaataagctattggtagttgtaggaaatcttagtatattttaaaagctgacatcccacctaattttaatctttggtctctaaaaagtaaatttcaaatttatgagtttaatcacttcaaatatgaatagcaaaaaatgagagcttgcttacttctaaaaattgaggttaagatatagctagtgtctgaacgacactccttaaagtaagttccaaatgtaaaacactccttaagttccaaatgttttccgctaatagtctgtcctaaagcctttgccattcctaatactcgttttgtaataattgctgtatttctgtgtaataaaatataaaaataaaatattcagtggtattcaacatc

SEQ ID NO: 3136 - DNA, 1943 bp, Homo sapiens
aggtaagaggaaactccattggataaatggcgaggaaacgtatactccctcttaaggaacacggtgtcttccttcgtctccgggttcccgagaccccagagtcactgacctccgtccctcagctttcggggttcggcagcagaaggggcgggcccgggcctgggattggctggcgtcgtccgacccccttcgctgctctccattcgcaatcgcccgcgggcgcctgcgcgatgggtcggccgtggggagcggggcgggaagcgcttcagggcagcggatcccatgtcggccctgaggcgctcgggctacggccccagtgacggtccgtcctacggccgctactacgggcctgggggtggagatgtgccggtacacccacctccacccttatatcctcttcgccctgaacctccccagcctcccatttcctggcgggtgcgcgggggcggcccggcggagaccacctggctgggagaaggcggaggaggcgatggctactatccctcgggaggcgcctggccagagcctggtcgagccggaggaagccaccagagtttgaattcttatacaaatggagcgtatggtccaacataccccccaggccctggggcaaatactgcctcatactcaggggcttattatgcacctggttatactcagaccagttactccacagaagttccaagtacttaccgttcatctggcaacagcccaactccagtctctcgttggatctatccccagcaggactgtcagactgaagcaccccctcttagggggcaggttccaggatatccgccttcacagaaccctggaatgaccctgccccattatccttatggagatggtaatcgtagtgttccacaatcaggaccgactgtacgaccacaagaagatgcgtgggcttctcctggtgcttatggaatgggtggccgttatccctggccttcatcagcgccctcagcaccacccggcaatctctacatgactgaaagtacttcaccatggcctagcagtggctctccccagtcacccccttcacccccagtccagcagcccaaggattcttcatacccctatagccaatcagatcaaagcatgaaccggcacaactttccttgcagtgtccatcagtacgaatcctcggggacagtgaacaatgatgattcagatcttttggattcccaagtccagtatagtgctgagcctcagctgtatggtaatgccaccagtgaccatcccaacaatcaagatcaaagtagcagtcttcctgaagaatgtgtaccttcagatgaaagtactcctccgagtattaaaaaaatcatacatgtgctggagaaggtccagtatcttgaacaagaagtagaagaatttgtaggaaaaaagacagacaaagcatactggcttctggaagaaatgctaaccaaggaacttttggaactggattcagttgaaactgggggccaggactctgtacggcaggccagaaaagaggctgtttgtaagattcaggccatactggaaaaattagaaaaaaaaggattatgaaaggatttagaacaaagtggaagcctgttactaacttgaccaaagaacacttgatttggttaattaccctctttttgaaatgcctgttgatgacaagaagcaatacattccagctttcctttgattttatacttgaaaaactggcaaaggaatggaagaatattttagtcatgagttgttttcagttttcagacgaatgaatgtaataggaaactatggagttaccaatattgccaagtagactcactccttaaaaaatttatggatatctacaagctgcttcttaccagcaggagggaaacacacttcacacaacaggcttatcagaaacctaccagatgaaactggatataatctgagacaaacaggatgtgtttttttaaacatctggatat

SEQ ID NO: 3137 - DNA, 320 bp, Homo sapiens
acaatctccgggaaggggcagagcagaaggtggtattcatcacaggacgagtccacccaggggaaacaccctcatcatttgtgtgccaagggatcattgacttccttgtaagccagcaccctattgcctgtgtcctccgggaatacctggtcttcaagatcgcaccaatgctcaatcctgatggagtctacctgggcaattacaggtgcttgtcattgatgaggaacggttccagaggcaggccatttttcccaagctcctctgccagaatgctgaggacttctcctattccagcacatcctttaaccgggacgctgtga

SEQ ID NO: 3138 - DNA, 681 bp, Homo sapiens
tctgatttttgcttgcctggtgcctggtttcccagcagtcatgtcatccaggggcccttgcacactggagacactcatcaatcccagccctagtgtagctgatgtaaagatatatccagaagaaatcactccactcctaccagccatatcaggggagaagattgctgaggaccaaacctgcttttttcttcaaatactgttgaagtatatggttattcaggctgcgagcttggagtggaagaataaggagaatcaagatactggttttaaatttctttttacattgtttcgaaagtattatcttcctcatttatttccatcatttactaagttaacaaacatctacaaacctgtacttgacatcccccatttgagaccaaagcctgtgtacattactaccactcgagacaatgagaacatttacagtacaaagattccatatatggcagctcgtgttgtttttattaagtggattgtaaccttctttttggaaaaaaagtatctaactgcaacacaaaacactaaaaatggagttgatgtattgcctaaaatcatccagactgttggtggtggtgctgtgcaggagagagcgcctgagctggatggtggtgggcccacggagcaggacaaaagccattctaacagcagcaccttgtcggaccgaagactcagcaactccag

SEQ ID NO: 3139 - DNA, 874 bp, Homo sapiens
acacggtatgggtgtagactggacccgccccctaaatccaggagaccatcaactatggaaaggagatctagggaacaccgtcttgaacccgccaggggttttgagtctcggacccaggagatccaaccctgaccaccctcccaggatgcagcagggggatgttaaatcagacttcaggaagaacttccttgctgcctgagttaggtgtcgtcacgcctgcccaggggccaaggaggcgggtttggtgcggccactccaaggccaaagcgagaaaatcttactgcgcacgcgcaatagacagccgatggagccaccgatggagccgtccggaggggagcaagagcccggagccgtcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgggtccgcagatcccgcgggccgcattggcccggctgctgcgggatgccgaggggctgcaggagctggcactggcgccgtgtcacgaatggctgtcagacgaggacctggtgccggtgctggcgcggaatccgcagctgcggagtgtggcgttgggcggctgcgggcaactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagagg

SEQ ID NO: 3140 - DNA, 1015 bp, Homo sapiens
gaagaagcaggcagcttgagacaggtggagctggatcaagctgtgaacgtgatttgctggaagctggtcattagtgttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagcttaaaaaagtgaggaggaagtaaatgctaaattattcatgagcctcatttgacagcacatcagaaggggaagtgtcaggggttttataaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcata

SEQ ID NO: 3141 - DNA, 577 bp, Homo sapiens
aatttttctctgcttgttggacatgaagagagggagacaaaggctctcagaaagagaaagacgggctggtgaaggacaaactaaggaatttgattattcacttttccaagataaagtggcatggagtggggaaagaccattaaggaatgctgaacataaaggaatcctggggacctgaccctcagttaagacataagaatgacaaccaggagtgtgctcgatgttgaaacatttgtagcagatatactgaaaggagaaaatttatccaagaaagcaaaggaaaagagagaatcccttattaagaagataaaagatgtaaagtctatctatcttcaggaatttcaagacaaaggtgatgcagaagatggggaagaatatgatgacccttttgctgggcctccagacactatttcattagcctcagaacgatatgataaagacgatgaagccccctctgatggagcccagtttcctccaattgcagcacaagaccttccttttgttctaaaggctggctaccttgaaaaacgcagaaaagatcacagctttctgggatttgaatggcagaaacggtggt

SEQ ID NO: 3142 - DNA, 834 bp, Homo sapiens
agatagaatctgcagtgcctgaaatccagcctgctgcttactcacatcctcatactcagctgcagactgcctgacagaagggctgccaaactgcactccagacagacaggtgcacagccaggcctgattcagcaggaagcatctcagacaccaaccactatgctgtcagcagttgcccggggctaccagggctggtttcatccctgtgctaggctttctgtgaggatgagcagcaccgggatagacaggaagggcgtcctggctaaccgggtagccgtggtcacggggtccaccagtgggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtg

SEQ ID NO: 3143 - DNA, 9618 bp, Homo sapiens
ggcaacagcaatgacatccgcgtggctggcacaggggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaattcccagtttggtctacacaggctcgcagctctcacctgtcctgctgtagcctgaatgctcccatgtgggaatagcaccccaccacctgcccagtgtctgcctctgctccgtgtctggggtgagcaccctcaccctgagactgtggctgatgatgatcagccaccaggaagaggctaaatgttaagatgggactgaagttggagccttcctgcgttccagttcctctaggagaggccaagggctgccctgctcccagcttcagggagcctctgcctacatgggatggcccactgtgtggcgtcaggtacctggcacccactgagcatccggggaattaggtccctcctgtgccccagagctgctaggcagactgctaggcggttgactcaaggtgttacctgctagtgcctggggtgaaggctgcatggagcccaaccttgctcctggccttcctgtgctcaggcctctccccttttcgccagggcttcctggtgcctctcccatgaagagggaacttcccctccactcccatggaagacccaggtttgggctgttgccagctttgaggccccctgtgggcttgcctgtcccaacccaagaggcagggctcaaagtgccacccgggggttgcaaggacagcagaggaccacctgccctctgcaggaagctgtccaggaagccgtgtcctgggctgtggtccttgctccccatggggagagctgggtcacttggcctcttctaactggccccaagcacgccaattctggagcatggttactaagtggctctgaagcttcagggtcaccacaggcttgtcctgactgcaaactcatggagtggttgcagccctggctcagtgtcctgatgactaggtgtgggtactaggctcctgcccctggtgacacacgtatggagtgggggagggtgggtggctgcacccctggttctggagtccccacagctgatggcggtgtgagcctggcatgcacggctgcgctggactccaggctgttgggggaggtgcctttattgcccaagcccacccctcacttggccttgccctgggcagccacagcctccatggccttccgcaccgtttcctcatcacccaggaactgcatgggcttggtgggcttcagctccttgttcagctcatacacaatggggatccccgtgggcaggttcagctccatgatcgcctggtctgacatccctatgccggaaggaataggtgtccttagcccctctgtccccagcctgtttacacagcagacactatgtgacctttatggtccacagagccagttcccctggcaccaattccttcccagccctgagaacgaggccacagaaatgttgccaaaggtcaaggagtaactgagttagaccaagcagcctacagaaatagcccagtggtgaaaaaaatggggacttcagccccacccaagtggctgtgatctgtggtggtgctgtccatagttccctcagcccagtgtgactccagccagactgaagttgagggtcaggaagggacactcaccctttgttttttttttttcttttctttttctttttcttttttttgagatggagttttactcctcttgcccaggctggagtgcagtggcacgatcttggctcactgcaacctccatctcctgggttgaagtgattctgcctcagcctcccaagtagctgggattacaggtgagcgccaccacacccggctaattttgtatttttagtagaaacgggttttaccatgttggtcaggctggtctcaaactcctgacctcaggtgatctgcctgcctcagcctcccaaagtgctgggattacaggagtgagccaccgtgcccagcaccctttggtttctaaagtgctctaaattctagacatcctgaacagaggagcaagtgcggaatggagctggaggagggacagggaggccgagcctggtcgaaacctgaccctgcctgcctcctgcagcccctgagctgggaatagcagctcgacctttgatgttcgcgccactccacccctgctccgtgcaggagggtttaagaaaatgttctctggggagtcagagtgaaatccctcatattcaccaccaaaagtgcgtcccctttccccaaaccaggctgtgggagggtcatggggctgcatgaagtctccggaagggagaggaggcaggtggtccttccctctgcctggccccagtgccaggtgccaggtgtccgtgtttggagcgggcaggcttggggctggctgggtctccggggcctgccggtctgggtgctctggccaactgcccaacggccctaggagcaggaggtctggggcacacccttctagcctttccaggactcaacaagctttaaggtcattcagatgctaatttagactgcccttgtgtcagaatactaaggtgggaggcggagcggaggtgccagtcactctgggcgaggccttactgcgcccatgcatcccgggcccatttgtcagcccttgctcttcagtgggagcccagctgcaagcccagagtctggccactccatagtcctgcacccctcttttgattggtctttcctttgcccagagaggggctccagagggagataggtggtgaagctcatgcagggattctgaggacctgatgggggagggccctgcgaggggtccaagcctacatcaagaggaattcagtaccagggggagctccccaccaccccggaaaagggagaggcccagagatggaggtggcttgtccagggccccacagtaagttgggatttggagccagatgctctaagcccagcccttccgtttcctagctgggtgtcccttggcagatgccacctttggagcctgccccacctcgggacacagcgagcttcgagtgcagtcagcccctgtggagtgtgtcccagttacacagaaatggggaaaatttcacaaaactaaaaaatggcttctcagccctcctttttcagtgaatgatgtggagccccacgcctagaaagcctggtccatgggcgagagactttgctgagatgagaagccagctggggctgctgcccacccaccctgcccaggctcctgaaggtggcctcaccttccaggtgcttgacaatgccccgcaggctgttcccgtgggctgcaatgagcactcgcttgccggccttgatctggggaacaatctcctcgttccagaagggcagggcccgggcaatggtgtccttgaggctctcgcaggtggggagttccccgggcttcaggcctgcgtaccgacgctcctgggggacacaggcacgctgctttccctcccaagccagtgggcccccacccgactccccactctgcagcttcccagaggccttcccagcaaaggcagcccaccttgctaatggagttgtagtaggggtgcttctcgtccatcgggggcggcgggatgtcgaaggagcgcctccagatcttcacctgctcctccccgtgcttggcggccgtttctgccttgttgaggcctgtgaggcccccgtaatgccgctcattgaggcgccaagtgcgcaccacaggcagccacatctggtccgtgccgtccaggatggcccagagggtgcggatggcccgcttcagcactgacgtgtagcagatgtcaaactccatcttggcatccttgatggccttggctccccgcttggcctcctcggtccccttttcactcagctctgcatcgaaccagccacagaaacggttctcctggttccatgtgctctcgccgtgccggaccatcacgaggcggtgagtggccatggtggcagcagggaccacagaggactctggacggggacggctgcttcccaacactcccagctttataatagtgtcttcccagcccccacccaccccagccaactgccaatcagcattccaggcggtggcaggtgaccagtagctgagctgctgggggctgggggccaggggagtgtgcaggccaagaggctgtgcttaaaatagccccacgcatccaccagctcctggcctgggttcaggtggcatgtctataaccagctggcacccagagcccagactgagtggggctgctggtcagggatgggcgtgaagggcagaagtctgggccaggggagatggggatagcagggacagaggggctctccagggcaacgctcagtggcctatcagccattctctgctcagacagaggcacaaacaaaatcccaacccctttctcctgtgattggcagccaggctaggaggcggccctcagcaggcagaggaggagagccagaggagctggtgcagaccacagctttgtggagaggagtctggccttgtggaaggtaccaggcagcagcagcagaatgggcaagggctggggctgagccgggtttccaggacaaagggggaaagggcccctgtctttcctccggggtccctttgtcaaggtctcatccatacatgccccatgctcccaccctatctgccctcacccaagccacgctcactctcctagccgaaaccaccttgaaaaagagaaatccaagggggtttgggggcaggactgaggactgtcagaagtcttgattgttaggtaaatgctcagcttagcaggaacccacaacgtaggctgaagggtggcacggagttgagtctaggaccaagacttctgcattcaggtttgggggatgagagccaccaaggcagggaagagactatgagcaataaagtcacaattggggccctaatgaaggggccatggccagacccttgggcatgggccccatccagggcctcccatttcctcccaccccagtgaccacactgtcacctgcgacacttctgataacaggagcgggtaggtgagaggccagcagagggaccaccactctgagacttggatctgagtgtgcaagaaaccctcgacaggcctccctccatccctgctggcctacctggggaggggctcctggcttggggcctgtgaagctaaggctctgtacccaaaggttggcagacaagtcccagtgggcaaagtcctgtcggctgccaggacccccaaggctggcaggtggaacccatccctcctagcagtgccatgcgcaggtctcactgttccacactgatcctgattgaagccacatctcctcatctgcttttgtccctttgaccaagagttgattcactagcccaactaaacatgactgaggaccaggctctggcagtcccacaggggccagacatgaagcccatatttcagtggaggagggatcgtaccagcagctaaacatgcctaccgtagatagcaccagatgctaggaaggaaggaccataatgtactgggagagatgggaaaggagaggccggggacagccctgaggtgacatgtgagtggaaagagcggagtgcaaaggcctcagctatgatgagtcctacagggagagcaattcaggtagaggggttggcaaagacccaagccctacagaaagcaaacaagctggggcagcgaccatcaggggcacatggcagagaggtgggctttgtgtcccaacacagtgggaatcactggagactttgaagcatggtcatattttcaagtcacttgcagctgtgtaggagtggaagtagaagctgagtaccctgcaggtctcggcagctttgatgagaacaaggccgcttagccagggctgggtgcagaagcagtggcaaggatcccccagacctgggagacctcactgccaaccaagcaggaggtgtcaaaaaggaaaggggagcccaaagaagggctggacttcggggaagcaagcccctgcttctgacccttggctccggcttgactttcctttgattcatttgacaagtagttgctggcctctgcagtgtgccagagctttcttggaggggtacaggggtaggaaaaccaaaagccaccctcagggcctccatccaggaaggcatagcatggtgggcggcgaggaaggctgctgagtcaacaaggtggtcccaggaaggtggagggagcatcttcccatgtctctcccactgacagccaccaatcctggacagatgcaggagcagctgtcagtagacagataagaaaaggagatcagattcaaagttccgcagagaagtggtgaggtaacaagtattgcctagcctggacacacaggcggcttgaaacctcaagtgcaccaacagaaagagctccaggaagaatcagaggagtgggatgtgaagcccctcgaagtcagtgagttgggggaatccctccaatttttcttttcttctctaccccagctcctgggcagtaacatggaggtggcagtggtggcacagtgacggtagtgtgagctgggtacgcacttgaaacctgagagggtaacgctaccctctgtctagaggagccatggccccaaaagcatggggcaaccaccttctgcagctcctttctgcccccctgcgctgggccctggatgcagtttcagggagtatgcagcagggtaggtagggaaagagccccagatttgtggctggaggtcttggtagggatgttgcagggagctgttgtgtttcagggagagtacagagaagggagagatgaagtgagtgatccgataaagtgatatgtgaagtcattggcttgctgccaagctgcgcacagggctgaccctagatgcacattgcaggtcccagactgaccggtgtagatacaggactaatatgactagtagtgcaaacactttaaacagtcaacattctgcttaggatttaaacaaggtccagagtctcaacataatatttaaaatatccaggttatccaaaataacccagtgtatgaaaaccaggaaaatcttaacatgggagaaaagaagatgatcaatacatgcccatcctgagatgattcaactattggaatgatcagatacagacttcaaagcagctatttataaccagccttcagaaagtattggtgaatattcttaaacagaatggaaatgacaaagcatggagtccataaattagatgatagtttggaaaaagatataaacttacaaaccaagaagctcagtgaaccacacaactggataaattaacaacaaaagtccaagcttagacacatcataaagaaacttctgaaaactaaagaccaagaaaaataagatcagccagagaaaaacgatacatttcattcaggtgaacaattctttgaaagactggatcttcaccagaaactatagaggccagaaagaagtggaacatttttagttttgaaataactgtcacccaagaattctatatccagtaaaaatttctattttactggaataaaagaatgaaataaagacattctcaaatgaaggcaagctgaggaaattcataaccaaagaatctgctttaaaaaaatgttaaaccaagttcttcagacagaagagattactgggggcaattcaaaactttgggaatgcaggaagaacatcataaatggcaaaagtccacataaatatgaaactattctttacttctttaagagttatgtgatggttgaattaagtcatgatactgtctgatggaggcttcagtgtatacagatgtaagacaactagaacatgaggggagaagggtgaagggacctagatggtagtgaggtttctacatgctacttgaaatggcaaaacattaatctaaattgactgtaagagtatgtgtatttggccgggcagg

SEQ ID NO: 3144 - DNA, 1476 bp, Homo sapiens; identical to SEQ ID NO: 1945

SEQ ID NO: 3145 - DNA, 2892 bp, Homo sapiens
tttgttcgcctctcttcggccctctactcaagagctccgtctccgtctcgccctcctcgaagtcctcgtcgcgcgcccgcgacccaggtcgccctgaaatctagcccgtccgagcgcgagtccaacgccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagagtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 3146 - DNA, 3626 bp, Homo sapiens
acggcgcgagtccgagggcgacagcagcgcgcaggcgcacgtcagtccccgcgcttttcggaggctgccagcgtcccacaccagccgcaggtgaaaaccggcagaaagacattaagagattttcctgcagtcactgctggcagatgatagagccaggatttgaaagcaggcagcctggctccagaccctgtgctcttaactcccgttttgcatcaagaacagaatcctatgaaaggcttgcacagtgcttggtactgagtaggcactccgtcagtattttagtagctattattccaaaggacactgtattctaggtactaagacaatgtgaatggaatggaaaacaattcctccctgcagaagccaactgtctaggaagacagataatgacattattaaaataatcagaacattggcaaaataaagaagattgaaatgcagttcatatgacagtgctaattaatcatactttttagatctaggaaaggccataaaggttaaattgacttggaaatggtaaacaagacaatggttgtgtcactgatcggtgatggccagtttttggttatccttatttgccatttaaatgattgaattgaaaggaagaagtaagacttggaagatgaatattgaaggaaaggtgaagatggaaaagagaagggggtttattctgagaacagtgactagaactctgaggatagcagcatcaaggagcattgtgtacatgcagaagtgcacagtacctggagtgaaactgcttgtgttcgatttctgataccattcataactggctgtgtgatctcaaaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtgacaagtggcagtctggattgtcaataaataatgttttcaaaatgagtagtgtacagaagatgatgcaagctggcaaaaaattcaaagactctctgttggaacctgctcttgcatcagtggtaatccataaggaggccactgtctttgatcttcctaaatttagtgtttgtggtagttctcaagagagtgactcattacctaactcagctcatgatcgagaccggacccaagacttcccggagagcaatcgtttgaaactccttcagaatgcccagccacctatggtgactaacactgctaggacttgtcctacattctcagcacctgtaggtgagtcagctactgcaaaattccatgtcacaccattgtttggaaatgtcaaaaaggaaaatcacagctctgcaaaagaaaacataggacttaatgtgttcttatctaaccagtcttgttttcctgctgcctgtgaaaatccacagaggaagtctttttatggttctggcaccattgatgcactttccaatccaatactgaataaggcttgtagtaaaacagaagataatggcccaaaggaggatagcagcctgcctacatttaaaactgcaaaagaacaattatgggtagatcagcaaaaaaagtaccaccaacctcagcgtgcatcagggtcttcatatggtggtgtaaaaaagtctctaggagctagtagatcccgagggatacttggaaagtttgttcctcctatacccaagcaagatgggggagagcagaatggaggaatgcaatgtaagccttatggggcaggacctacagaaccagcacatccagttgatgagcgtctgaagaacttggagccaaagatgattgaacttattatgaatgagattatggatcatggacctccagtaaattgggaagatattgcaggagtagaatttgctaaagccaccataaaggaaatagttgtgtggcccatgttgaggccagacatctttactggtttaaggggaccccctaaaggaattttgctctttggtcctcctgggactggtaaaactctaattggcaagtgcattgctagtcagtctggggcaacattctttagcatctctgcttcatccttaacttctaaatgggtaggtgagggggagaaaatggtccgtgcattgtttgctgttgcaaggtgtcagcaaccagctgtgatatttattgacgaaattgattccttgttatctcaacggggagatggtgagcatgaatcttctagaaggataaaaacagaatttttagttcaattagatggagcaacaacatcttctgaagatcgtatcctagtggtgggagcaacaaatcggccacaagaaattgatgaggctgcccggagaagattggtgaaaaggctttatattcccctcccagaagcttcagccaggaaacagatagtaattaatctaatgtccaaagagcagtgttgcctcagtgaagaagaaattgaacagattgtacagcagtctgatgcgttttcaggagcagacatgacacagctttgcagggaggcttctcttggtcctattcgcagtttacaaactgctgacattgctaccataacaccggatcaagttcgacccatagcttacattgattttgaaaatgcttttagaactgtgcgacctagtgtttctccaaaagatttagagctttatgaaaactggaacaaaacttttggttgtggaaagtaagtgggatacttggaatcaaggcatctctgtagtacagtcttctttattttttagcatagaaagttggggatgtgttaattgtatttttaagaatatattctaagttctgtacttcaaataatagcacagattttacatctgattgacatagtgtatgttaatgtaagttttgctttccagtgattacctgatacgtaagcctatttgaacaaagtgagaatgaacttttgtttctaagaagtctttatcttgaagctatataacatgaaaagtgagctcaaattttttttagttgaagattacatataaagttgtgtctgattaatattcatcttttattgaagaaagtgccttctgatggccacataattcttaatgtcagctagtataatggtttacatttggacaaagtattgcttagtgttatttaagtagatttaagatctcaaagctaaagtgccaatttttactttcttcagccaatttgttacctcttttatggtttttaatttttatcaggactaacattttcagaaatagcaaggtgtgatctagtattagattcacagaactgaaaggttaattaagaatgttggttattttcacgggagcgtgtgatatttaacattaatattttatttgacactacagcctgtaatactgctctctttcaaaaacaagttttcagatttttataacagacccattttgttttatgaaacatgttcattacagaaacatgagaaaatagagataagtaaaaagaataaaagtcactattatcct

SEQ ID NO: 3147 - DNA, 1644 bp, Homo sapiens
tcacttcctcccgaagacgctgtttcctagcaaccgccctccgcctctgttattagcccctcctcctcgctcggtccaggaccggctctgcgggcgccgccaggcccagaccaagctactatcagaagttgaattctaataattagctattttataaaggtaacgagaaaaaatacactatgtctgatgaagtttttagcaccactttggcatatacaaagagtccaaaagttaccaaaagaactactttccaggatgagctaataagagcaattacagctcgctcagccagacaaaggagttctgaatactcagatgactttgacagtgatgagattgtttctttaggtgatttttctgacacttcagcagatgaaaattcagttaataaaaaaatgaatgactttcatatatcagatgatgaagaaaagaatccttcaaaactattgtttttgaaaaccaataaatcaaacggtaacataaccaaagatgagccagtgtgtgccatcaaaaatgaagaggaaatggcacctgatgggtgtgaagacattgttgtaaaatctttctctgaatctcaaaataaggatgaggaatttgaaaaagacaaaataaaaatgaaacctaaacccagaattctttcaattaaaagcacatcttcagaaaacaacagccttgacacagatgatcactttaaaccatcacctcggccaaggagtatgttgaaaaagaaaagtcacatggaggagaaggatggactagaagataaagaaactgccctcagtgaagaattggagttacattctgcaccttcttcccttccaacgccgaatggcatacaattagaagctgagaaaaaagcattctctgaaaaccttgatcctgaggattcatgcttaacaagtctagcatcatcatcacttaaacaaattcttggagattctttttcaccaggatctgagggaaacgcatctggaaaagatccaaatgaagaaatcactgaaaaccataattccttgaaatcagatgaaaataaagagaattcattttcagcagaccatgtgactactgcagttgagaaatccaaggaaagtcaagtgactgctgatgaccttgaagaagaaaaggcaaaagcggaactgattatggatgatgacagaacagttgatccactactatctaaatctcagagtatcttaatatctaccagtgcaacagcatcttcaaagaaaacaattgaagatagaaatataaagaataaaaagtcaacaaataatagagcatccagtgcatctgccagattaatgacctctgagtttttgaagaaatctagttctaaaaggagaactccatcgacaactacctcttctcactatttagggactttaaaagtcttggaccaaaaaccttcacagaaacagagcatagaacctgatagagcagataacataagggcagctgtttatcaggagtggttagaaaagaaaaatgtgtatttacatgaaatgcacagaataaaaagaattgaaagtgaaaacttaaggatccaaaatgaacagaaaaaagctgctaaaagagaagaagcattagcatcatttgaggcctggaaggctatgaaagaaaaggaagcaaagaaaatagctgcca

SEQ ID NO: 3148 - DNA, 926 bp, Homo sapiens
ccgcgatggtgagagagccgggcccccggccagggacccccggctgttcggcctcagggcagtggactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccagtggctgtgactggtcccag

SEQ ID NO: 3149 - DNA, 2084 bp, Homo sapiens
ctagcttggcctcttccctaagaaataaagaaggcactttggggtccaaggtagggtacttagatgtggaagcaaggggccccggggaggggcggggaggcggcggagagagcccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattgatgaggccttgtcccagaactgcggggtgctcgtccactgcttggcgggggtcagccgttctgtcaccgtcactgtggcctacctcatgcagaagctccacctctctctcaacgatgcctatgacctggtcaagaggaagaagtctaacatctcccccaacttcaacttcatggggcagttgctggactttgagcgcagcttgcggctggaggagcgccactcgcaggagcagggcagtggggggcaggcatctgcggcctccaacccgccctccttcttcaccacccccaccagtgatggcgccttcgagctggcccccacctagggccccgtggccggcaggccggcccctgccccacccccacccacgggtgtccctgcccactcgtgtggcaagggaggggagggcaggagggctcggcctgagcagggtgctggggggagagcgcaatacctcacgcgggctgccgtcctaatcaacgtgcctatggcgggaccacgctcggagcctgcctcttctgcgactgttactttttctttgcgggatgggggtgggggttccctctccaggtggttgtccaggcccatgtcccggccctgggtgctcagccagctcggctaggccctgcgcctccctgcgcttcccccttcaggaagggtgtgtgccacctcgttgcactggatcccagtggctgcttgggggagaggcgtttgccatcactggtgttgtcacctccctgtttctccaccaagggcttgggcctctcggggctggggcctcccaggggatggggacccagagtgcagtggccgcccacatccatggcctaggagctactgggcaggttcccggccacacatctggtgggctgttttgttttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaagata

SEQ ID NO: 3150 - DNA, 162 bp, Homo sapiens
ctagggaccccgaaatccgaccgcccatgggaagccactcgccagagtcttacctgagtgaaaaatgccatggccttgtttctcatagcaggggattccttaccccatcaccatgtgcacctcagaaactttccaagcgctggacaccttcgaagccagaca

SEQ ID NO: 3151 - DNA, 3250 bp, Homo sapiens
gagtcaggaatggagagaagggtaatggttttacctcttattgtggaaacctgttgagatcacagagaatatactgacggcataaaagggcagaaccatagcagggtgcgcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 3152 - DNA, 603 bp, Homo sapiens; identical to SEQ ID NO: 2780

SEQ ID NO: 3153 - DNA, 2549 bp, Homo sapiens
atggaaccagagaggaaggggctatcgttggcttcttcttcagatggagacgggagagaagaaaataaattaaaacaaggaatttcccaagacttggcttcttcctccagattagacagatacaaaatagcaaggcagttaacagaaaaagcaatcaaggagaagaagattttctctatctacggacactacccggtggtccgggccgctctgcgaaggaagggctgggtagagaagaagttccactttttgcccaaggtcattccggatgtcgaggatgaaggcgcccgggtcaatgatgatacatgtgccaaagtcaaagaaaatcaagaaatggctttggagaaaacagacaacatccacgacgtgatgtctaggttggtaaaaaatgagatgccgtacctcctctggaccatcaagagggacatcattgactatcacagcctgacctacgaccagatgctgaaccactacgcaaagacagcctccttcaccaccaagatcgggctgtgcgtgaacatgcggagcctgccctggtacgtcccggccaaccccgactccttcttcccacgctgctacagcctctgcaccgagagtgagcagcaggagttcctggaagacttccggcgcaccatggcatccagcatcctcaagtgggtggtcagccaccagagctgcagcaggagcagcagaagcaagcccagggaccagagggaggaggccgggagcagcgacctgagcagcaggcaagatgctgaaaatgctgaggcaaagctcaggggcctcccggggcagcttgtggacatcgcgtgcaaggtgtgccaggcctacctggggcagctggagcatgaggacatcgacacgtcagcagatgccgtggaggacctcactgaggccgagtgggaggacctgacccagcagtactactccctcgttcatggcgatgctttcatctccaattcaagaaattacttttcgcagtgccaggctctgctgaatagaatcacgtctgtgaaccctcagacggacattgacgggctccggaacatctggattataaagcccgcggccaagtcccggggccgagacatagtgtgcatggaccgtgtggaggagatcctggagctggcagctgcagaccaccctctttccagggacaacaagtgggtggtccagaagtacatcgagacgccgctgctcatctgtgacaccaagttcgacatcagacagtggttcctcgtcacggactggaaccccctgaccatctggttctacaaggagagttacttgcggttctcaactcagcgcttctccctggacaagctggacagcgccatccacctgtgcaacaacgccgtccagaagtacctgaagaatgatgtgggccgcagccccctgctgcccgcacacaacatgtggaccagcaccaggttccaggagtacctgcagcgccagggccgtggcgccgtgtggggcagcgtcatctacccgtccatgaagaaggccatcgcccacgccatgaaggtggcccaggaccacgtggagcctcgcaagaacagctttgagctctacggggctgacttcgtccttgggagggacttcaggccctggctgatcgagatcaattccagccccaccatgcacccgtccacgccggtcacggcccagctgtgtgcacaggtgcaggaggacaccatcaaggtggccgtggaccgcagctgtgacatcggcaacttcgagctcctgtggaggcagccggtggttgagccgcccccattcagcgggtccgacctctgcgtggcgggcgtcagtgtgaggagagccaggaggcaggtgctgcccgtctgcaacctcaaggcctcggcctcgctgttggacgcgcagccgctgaaggcacggggcccctcggccatgccagaccctgcccagggacccccatcaccagctctccagcgggacttgggactgaaggaagagaaggggctccccctggccttgctggcacccttaaggggggcagccgagagcggtggagccgcacagcccacccgcaccaaagctgctgggaaggtggagctcccggcctgcccctgtcgccacgtggacagtcaggccccaaacaccggtgtccccgtagcccagcccgccaaaagctgggatccaaaccagctaaatgcgcacccgctggagcctgtgctgcggggcctgaagacagcagagggcgcgctgcgtccgccgcccggaggaaaaggagagggcacggtctgcagccgcctgccacaccacgggcaccacgtggccgcctgccagaccacgggcaccacgtgggatggtgggcctggggtgtgcttcctccggcagctcctggcatcagaactgcccatgggccctgggctgccgagggacccccgagcgccgccctgcctcgtgtgccgcgggctgctgccacccgccgggccctgcaagcgctgccgctcgttctgcgccgcggtcctgcagggcgcgtccttcgtgcggctcggcgggcggagctgcagcccgcggacccc

SEQ ID NO: 3154 - DNA, 3599 bp, Homo sapiens
aacaaccccgaggtcttatttttatagaatatcaagaacaaaatcttccaaaaggcacacgatgccaaactaaaaataaagagcgaaaacccaaaaagtcgcgctcaattccttctgaaacctattcgcctcctacccctgtcccatcctctggcgctggcgggtcctcgtccccgttttccccaccgcaagtcctggaacctccgcttaactcttttctcggcggctccgccccggccccgccccagccatgccttggccccgccccgttcgccgtttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgacctatttaagaaaaataccacgttttaatgcagattctggctattccatccattctgattcagaaagtcaggctgaaactgtacacgggcttgatggttgtgcttctttgctgagggacattttgagaaatgaagattcagcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagcggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaactcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccaca

SEQ ID NO: 3155 - DNA, 713 bp, Homo sapiens
cccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgccca

SEQ ID NO: 3156 - DNA, 3772 bp, Homo sapiens
gccgccgccgccgccgccgccgcgccgcggcttgagggcgggaggctgggggagggtagcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaaaccacagcttttggaccctaaaaggtctggattgatcgtactgctttctgaaagaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttttttcttagttttccaggcttaacatttttgattttgttttttaatgtttggaacataaatgaagatttgatacattatttcattatctaaaaaggattaattattcatgctcattgtaagaacttcattttgtagcaaatggcatatcacaggatctgtccagataatcgatattttcagtatacaaatgtaaataatcacagatgagaatgtacttagctgtattttcaaataagtaatcttccccccttttgtaggactttaaaactaggcatcaatgaacctgtttttcctattatgcctggaatttagtcatgataccttgactcattccatcatatttcaagaggattcagagtgctagaaattattttggtagcctgtaacacacggcaacactggtccttgggcctatgatgacccacagatgactcagtatagagttcattgctaattataaattactagtgaatctttttgatattttaagctctagtgggaaaaatctggccacttttgtgtttttatgaaggccatggaataaaaggatccaaagatttaaatatttttatctaatattttgattgttttcttaactttctccttaaaacattcagtagtgataaagatatagaaactgcactgtaggagaattggaatatttaaggctggttgacattttttattttcattttatatcttttgtatagctctacaaggcagtgttttgtaatttggtttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaataaaaaatgctcgtcaaagttctttctctttaaatagtaacattctgtttcagtaggaacataatgaaaggaatcttttaaatggaagagcggaattataatgtttgtattccctgtaataactataaatcagttactttatttctaagattgagttattgttgcagatgtttagggaaagctaaaagccccttccttcccctcctgtgtgtaaataaaatacttctgagatca

SEQ ID NO: 3157 - DNA, 5669 bp, Homo sapiens
agactgaggctggctggctggaggttgacacaggagtgctcaggggagcagcatcacaagagggcagatcgaaagcatcgtccttgctgaaaaacagatggcagaggtggaagcggtacagctgaaggaggaaggaaaccggcatttccagctccaggactacaaggccgccacaaatagctacagccaggccctgaagctgaccaaggacaaggccctgctggccacgctttatcggaaccgggcagcctgtggcctgaaaacggagagctacgtccaggcagcttcagatgcctccagagccatcgacatcaactcctcggacatcaaggctctgtatcggcgatgccaggcactggagcacctggggaagctggaccaggccttcaaagacgtgcagcgttgtgccaccctcgagccacggaaccagaacttccaggagatgctgaggagactcaacaccagcattcaggagaagctccgagtgcagttctccacagactcgagggtacagaagatgtttgagatcctcttggatgaaaacagtgaggctgataagcgggaaaaggctgccaacaatctcattgtcctaggccgtgaggaagcaggggctgagaagatcttccagaacaatggagtagccttgctactgcagcttctggacactaagaagcctgagctggtgctggctgcagtgcggaccctgtcgggcatgtgcagcggccaccaagccagagccacagtgattctgcatgcagtgcggatagaccgaatctgtagcctcatggccgtggagaatgaggagatgtctctggctgtctgcaacctgctccaagccatcattgactccttgtctggggaggacaagcgggagcatcgagggaaggaggaggccctggttctagacaccaagaaggacctgaagcagatcaccagccacctgctggacatgctagtcagcaagaaggtgtctggccagggcagggatcaggcgctgaacctgctcaataagaatgttcccaggaaggaccttgccattcatgacaactcacgtaccatctatgtggtggataatggtctgaggaagatcctgaaggttgtggggcaggttccagatctgccatcctgcctgcccctgactgacaacacccgcatgctggcctctatcctcatcaacaagctctatgatgacctgcgctgtgacccggagcgcgatcacttccgcaagatctgtgaggaatatatcacgggcaagtttgacccccaggacatggacaagaacttgaatgccatccagacagtgtcagggatcctgcagggcccctttgacctgggcaaccagctgctgggactgaaaggtgtgatggagatgatggtggcactatgtggctcagagcgcgagacggaccagctggtggccgtggaggccctcatccatgcctccacgaagctcagccgcgccaccttcatcatcaccaatggagtgtcactgctcaaacagatctacaagaccaccaaaaatgagaagatcaagatccgcacactggtgggactctgtaagctcggctctgcaggtggcacagactacggtctcaggcagtttgcggaagggtcgacagaaaaactggccaaacagtgtcgcaagtggctgtgcaatatgtccatagacactcggacccgacgctgggcagtggagggcctggcctacctcacgctggacgctgatgtgaaggacgactttgtccaggacgtccctgccctgcaggccatgtttgagctggccaagaccagtgacaagaccatcctgtactcggtggccaccaccctggtgaactgcaccaacagctacgatgtcaaggaggtcatcccagagcttgtccagctcgccaagttctccaagcagcatgtgcccgaggaacaccccaaggacaagaaggactttatagacatgcgggtgaagcggcttctgaaggcgggtgtcatctctgccctggcttgcatggtgaaagcagatagtgccatcctcactgaccagaccaaggagctgctggccagggtattcctggcactgtgtgacaacccaaaggaccgaggcaccattgtggctcaaggtggtggcaaggccctgattcccctggctttggagggcacagatgtgggcaaggtgaaggcagcccacgctctagcaaagatcgctgctgtctccaatccggacattgcttttcctggggagcgggtgtatgaggtggtgcggccccttgtaagactcttggacacacagagggatgggcttcagaactatgaggctctcctaggcctcaccaacctgtctgggcggagtgacaaactccggcagaagatctttaaggagagggccttgccagacatcgagaactacatgtttgagaatcatgatcagctgcggcaggcggccaccgagtgcatgtgcaacatggtgctccacaaggaggtacaggaaaggttcttggctgacgggaatgaccggctgaagctggtggtgctgctctgcggggaggatgatgataaggtgcagaatgcggctgcaggggctctggccatgctgacagcagcacacaagaaactgtgcctcaagatgactcaagtgacaacccagtggttggagatcctccagcggctttgcctgcacgaccagctgtctgtccaacaccggggcctggtcattgcctacaacctactggcagccgatgctgagctggccaagaagctggtggagagtgagctgctggagatcctgactgtggtgggcaaacaggagccagatgagaagaaggcagaagtggttcagacagcccgagaatgtctcatcaagtgcatggattatggtttcattaaaccagtgtcttagacagcgaccctcagggatgctgggagtggtcctgtactgtgcagagtcctgggttggttgggttctcctgaagagtcaggtcatctagggatcatagcagtgacaatgaagtctcaatataaaggaaagacttgattgttctctgagttgtgagtcttctcctttgtcctgacagagtttggatgtttcactctctctcttgcttcctgtctccttatatttgtcatgtttcagaaattcccagaataattttcacccatgattagaaataggttggatcattctttctgtacccattctgaaggccaggataataggttgaagttctttatattttggaaaatggattttgtggtaaggtaggaactaacgggtgtgtgcatataaaggttaatgctgttgtatttggatgctgatctgtgctgttttcatgacctctctcccacactatttgaatcagtctgttcagaactgtgtgtttcacctgcagtgctctgtcccagtcccatgcccattcccatcacttcactgtgatggaaatagagtttatgttcaacagtggggcatgacctctgcaatttgcttgggaaagtcttccaagcaagatggacatgatgaatacaaataagatctactcaaagtacttcaaacaaaaaataaataattcattggctcatgtatcttggccacccagggaaggtctgacattgttagttagatccagagtttcaaatgtcatcaccatggatgtgtctttttctctctctcatttcccctccccatatcttgtcttttatttattataggtttgtctcattccctggcaggctctctccctgtgataggaaagagagtccccagcagccccagggtgacatagttgttatagttcattatggaatagaagagagaagagcattctcaataacccggcaaagttcccagggatgactctgatatgtctatgtctcaggtcacatttccatctatgaaccaatcatattcagaggtggaatgctaattggccaggcctgggtcatatatacaagtctagggaagaaatgagcttcatccctgtccaattgacatggactgattaggggtattaatggaagaggtgtgccaccacaaaagaatgtaccctgggcagatcaaagaacatattctgtatgtcaggcttggccacaaaagaatgacacaagtaatatgctgtagatcagaacctctctgctaatattgcctttttagcatggttaagatagctaagatctagtactgtcactccagtatgtcccaattctacctacgtttattgaagggtcaacagttctgatctcagcattgggtaaagggtgggacattcagatttacggtccttgataaaaacaatttacaacgttccgttgtgtaataaatgtaagtgtacatatgcctgggacatcagctggaaaagggacagactatcagagagttgcactgttgcggtatgggccaaatccaacataatacccgctgtacctctagagaactaaaaccttaatttctcagatcttttctgcactaatggtctttacatacagcctacattttaactaactcttgcatgggcttgtttcacagcaggaaactatattcatcatatccttattatgatagagaatgacaacattcaaaagggtgtggtgcttctgaaaatatacacaataaatggcatgatttgacctctgtcaaattcttctttcctgctttcctcatatgtgggcttgagtgggtgtatttagctcctttaaaggaaactctttcacaggcagggccacactcttactcgttttgatctcatgaggttacatctgccagtggcgttcagggccagttagataaagttcatcttgtttggattggagagactttttttttttttttttttgagacagggtcttgctctgtaacctaggctcaagtgcagtgcagtggtgcagtcatggctcaccgcagccttggtctcctgggctcaagtgatctttctacttcagcctcctcaatagctgggactacaggcacacaccaccacccccaggtaattaaaaaatttttttttgtagagacagggtctcactatgttgcccagtctgggagaccacattctttaacatgaatattttgtaaatagtccaagaagatctagaggaaagctgaattccttcatctgatttttgccactgggctgcctcccattgtctggctaagtcttcatgggaggcctttaagaaaagctgtgacaaatacctttgtttcccactgcctaggttacataagtagttggcttttccagcctagactcttatattgttgcttgtaagagggcccttctttgcagatttcttttttttttcatctatgctttcaaataggcagatgctagcctgagatcatctctttattgaggtagtttgcccaaaaacagcaaggaacagccaatacctgccaactttctaggtttttccaaccaattctcttacagaaaatctataaatatcttagaggtatgtttcttagtttcccaacatataatgggaaaattcatcatttatattattacttttaactgaagtatgttgttatcagagaacttggtctgtgtcatattaatcctttgccatttgagaagcatacagttttaaagtttatatctccaaaaggatattttgtaaaaatttaacccctttgactcttagtcttctcatttgtgaaaggtaaataataaagaatttctgttcctagt

SEQ ID NO: 3158 - DNA, 246 bp, Homo sapiens
atgagtcactacggcagctactacggaggcctgggctacagctgtggaggcttcggtggcctgggctatggctatggctgtggatgtggcagcttctgcagacggggttctggctgtggctatggaggctacggatatggctctggctttggaggctacggatatggctctggctttggaggctatggatatggctgctgccgcccatcgtacaatggaggatacggattctctggcttttattaa

SEQ ID NO: 3159 - DNA, 206 bp, Homo sapiens
ggccggcagagagagcctggatacgaagcaggcgggcttcagagtgggttggaaaaatggaggtgccgcgcctggatcatgccctcaacagccccaccagcccctgtgaggaggtgatcaaaaacctcagcctggaggccattcagctgtgcgaccgggacgttgtttttgaagaacttacatccaaacagacaagaaaaggataa

SEQ ID NO: 3160 - DNA, 1918 bp, Homo sapiens
ggacgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaaaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatc

SEQ ID NO: 3161 - DNA, 2119 bp, Homo sapiens
tcgtcatggccagtgtctgtctggcgcccggtgcccaggcactgtgcgagaccagtccgcaggggcgactcggagagcgccgggccgcggcgggagaagagcctgcagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagaagtaaaataagtgaacttacaactgaagttaataaacttcagaagggaatagaaatgtacaatcaagagaattcagtatatttgtcatatgaaaagagggctgagactttagctgttgagataaaagagcttcaaggacaactagcagactacaacatgttggtagataaacttaataccaacactgaaatggaagaagtaatgaatgattacaatatgcttaaagctcaaaatgatcgagaaacacaaagtttggatgtcatatttactgaaagacaagcgaaagaaaaacaaatcagaagtgtcgaagaagaaattgaacaggaaaaacaagcaacagatgacattatcaaaaatatgtcttttgaaaaccaagtcaagtacctagagatgaaaaccacaaatgagaaactgttacaggaattagatacacttcaacaacaattggattcacagaacatgaaaaaagagagcctggaagcagaaatagctcactcccaggtgaaacaggaggcggtattgctgcatgaaaaactttatgagttggagtcccatcgagatcaaatgattgcagaagacaaaagcataggatctccaatggaagagagagagaaattacttaagcagattaaagatgataatcaggaaatagccagcatggaaagacagttaacagatacaaaagaaaagataaatcagtttattgaagaaattagacaacttgacatggatttagaggaacaccaaggtgaaatgaaccagaaatacaaggagctaaagaaaagggaggaacatatggacacttttattgagacttttgaggaaacaaagaatcaggaactgaaacgaaaggcacagatagaagccaacattgttgcactcttggagcactgcagtcgaaatataaatcgtatagaacagatatcctctatcaccaatcaagagctaaagatgatgcaggatgacctcaattttaaatctactgaagtgcagaaatcacaaagtacagctcagaatttgacttcagacattcaacgtctgcagttggatctgcagaaaatggagcttctagaaagtaagatgactgaagaacagcattctctaaaaagcaaaattaagcaaatgacaactgatctggagatatataatgatttgccagctttaaaatcatcaggtgaagaaaagataaagaaattacatcaggagagaatgatattatcaacccacagaaatgcctttaagaaaataatggagaagcaaaacatagagtatgaggcactaaaaacacaattgcaagaaaatgagacacattctcagcttacaaatttggagagaaagtggcaacaccttgagcaaaataattttgcgatgaaagaattcatagcaaccaagagtcaagagagtgattaccagccaattaagaaaaatgtgaccaagcagattgcagagtacaataaaaccatcgtggatgctttacatagcaccagcggaaactgagtttaagtccactgaaagtctctaaggaagtatcctcttgctgctaaacttggtacaagttgactaccaaaaaaaaaaaaagcttacttttggagtttacctaaaatttctgaatgttataatttttgtggcctcttttaagaatgatattttaaaatagtaaatagttcaataaatggtttgcatatt

SEQ ID NO: 3162 - DNA, 540 bp, Homo sapiens
agtgtaaccaatcaagcagaatctctaggcgttcgtgctttgaaatgaggctccacatagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccag

SEQ ID NO: 3163 - DNA, 603 bp, Homo sapiens; identical to SEQ ID NO: 2833

SEQ ID NO: 3164 - DNA, 460 bp, Homo sapiens; identical to SEQ ID NO: 2760

SEQ ID NO: 3165 - DNA, 681 bp, Homo sapiens
gtacgggagctggaggctgagcttgatgcagagcagaagaagcacgccgaggcccttaagggcgtgcgcaagcatgagcgccgtgtcaaggagctcgcataccaggtgggcgacagggtctccctggggagtggccctggagctggcccagcccaagcaagccctgagtcccccttgcccgcccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctcca

SEQ ID NO: 3166 - DNA, 2296 bp, Homo sapiens
agacttgcttcaggttccaacccggtaaggcaaatggagaggctgtcaggagaccagaagtttacctcagctattgcaccgacgcaccacgtgctctggtgcacatccaccgcctcttcctgcctcagtttctccttttgtaaaacaacagcttgtaaaggcctggggatcttctcatccacgggagttttctaaggatgcaggcgaaagaggatctcactctgttgcctaggctggaatgtggtggcatgatcacagctcactgcagccacaaattcctgggctcaagcaatcctcctgcttcagcctcctgagtagctgggactataggcaagcgctactgtgctcagctctcactctctggctgaatgtagaggactctgaaggcttaggcaagaggggagttataaggcaccacagaaccctgaatgactgcatggagcagaacccttcgcaaacctgctcttcaggcctcctttttgagacagctggaaaagattctttctccttttctagcaattacttcctccctccgactcaaatgcctactcagcctctagtattcagtggctgctgcagtttgcggggttcttctccagaccatagatgcctcagtttttgcagtacctggaggtttcaccagtgaaagctctgaaacagcaaagatggcagcctgccctttcctctgggagttccatcctaggggtgtacagaactgttgctggcctgaatacacctgcatgaggtggctgaagactccagttggattatttatgaggatggcctgtgcaaaaagacacccagagatttcatgctgttgattcacagaaagcctgttcctcttcactccgtagagtcctcagagtctggatcatcccttacagaagatccttgataatatttctgatatacctccaaggttccgtttgtcaaatgtgtgcgacccttctgataagtcaccagaggtgatgagggagagagagaaagaaagcaaattacaactgtaaagagtctctgaacagtgaaagatcaaaacagacagtctctggctttactggatgagtcaccattgcagcccgaccgcaaaaacaagcgtggcttctgtacttagcagcagtcttcctgtctggaaaggaaacattgctcagattggagatactggccattttatagacttcaaagcaacttaggccactgaactgtcaggcgggaaaacaggctgaagaaatgtcaacaattgggagttttgaaggattccaggctgtgtctctgaagcaagagggagatgaccaaccctctgagactgaccacctatcgatggaggaagaggacccgatgccaagacagatttcaaggcagtcaagtgtgaccgaatcaactctttaccccaatccttatcatcagccttatatctcacggaagtactttgctacacggccgggggccattgagactgccatggaagacttgaaaggtcacgtagctgagacttctggagagaccattcaaggcttctggctcttgacaaagatagaccactggaacaatgagaaggagagaattctactggtcacagacaagactctcttgatctgcaaatacgacttcatcatgctgagttgtgtgcagctgcagcggattcctctgagcgctgtctatcgcatctgcctgggcaagttcaccttccctgggatgtccctggacaagagacaaggagaaggccttaggatctactgggggagtccggaggagcagtctcttctgtcccgctggaacccatggtccactgaagttccttatgctactttcactgagcatcctatgaaatacaccagtgagaaattccttgaaatttgcaagttgtctgggttcatgtctaagcttgttccagctatccagaatgcccacaagaattcaactggatctggaagaggaaagaaactgatggtgttaactgaacccattttgattgagacctacacagggctgatgtcattcattggaaaccgcaacaaacttggctattcccttgcccgtgggagtattggtttttgagagtctttttggtaccataagcatatcatccacagatatgtcactttgaaaattccagtttgacccacgctatttttggactgaaacaattaattatttttaaatgacgctttatgatttagaaatttagtatttccgaaaatttaaaagcttgattggactgatagatacacactttagacctcatacaagaataatcaaattttcttaaaactagaaaataaatgctgctgagcctatc

SEQ ID NO: 3167 - DNA, 336 bp, Homo sapiens
tctgcgcaagaaccgccggcgggtgtttgggctgcttgagcggccagtgctgctgccgcctgtgtccattgacactgccagctacaagatctttgtgtccgggaagagtggtgtgggcaagacggcgctggtggccaagctggctggcctggaggtgcctgtggtgcaccacgagaccaccggcttgcatggagaacacagatgccttcctcttcctcttctccttcactgaccgtgcctcctttgaagacctccctggacagctggcccgcatagcaggtgaggcccctggtgtcgtcaggatggtcatcggctccaaatttgaccagtacatgc

SEQ ID NO: 3168 - DNA, 3524 bp, Homo sapiens
atgggcacaggggattttatctgcatttccatgactggaggggcgccctgggggttcagattgcaaggtggcaaggagcagaagcagcccttacaagttgcaaagattcgaaatcagagcaaagcctctgggtctgggctctgtgagggagatgaagtggtttccatcaatggcaacccttgtgcagatctcacctaccctgaagtcatcaagctcatggaaagcataacagactctctccaaatgctcatcaaaagaccatccagtggaataagtgaggctttgatatctgaaaatgaaaacaaaaacctcgagcatctcacacatgggggttatgtggaaagtaccaccctgcagattcgaccggccacaaagacccagtgcacagaattcttcctcgcccctgtcaagactgaagttcccctagctgagaaccaaagaagtggtcccgactgtgcaggcagcttgaaagaagaaacaggcccgagctaccaaagggctccccaaatgcctgactcccaaagaggacgcgtggcagaagagctgatcttaagggagaaggtagaagcggtacagcctgggcctgtggttgagctgcaactgtccctttcacaggagagacataagggcgctagtggccctttagtggctctcccgggagctgaaaaatctaagtctcctgacccagaccctaacttgtcacatgacaggattgtccacataaattcgatccctactaatgagaaagcagaccctttcctgaggtccagcaagataatccagatctccagtggcagagagttgagagtgatccaggaaagtgaagcaggagatgcgggactgccccgggtggaagtgatcctcgactgctctgacaggcagaagacagaagggtgcaggcttcaggcaggaaaggagtgtgtggattctccagtggaaggagggcagtcagaagcacctccttctctggtatcctttgccgtctcatcagaaggcacagagcagggagaagatccacgctcggaaaaagatcacagcagacctcacaagcaccgagcgcggcatgcacggctcaggaggagtgaaagcctgtcagaaaaacaagtgaaggaagcaaaatctaaatgcaaaagcattgcccttcttctaacggatgctcccaaccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttcttggtgcaagcgaatcagaggtggatgaagagttattgtctgacgttgacgacaacacacaagttgtgaactttgactgggattctggactggtggacattgaaaagaaactgaacagaggggacaagatggagatgttaccagacaccacaggcaagggagccctcatgtttgccaagaggagggagagaatggatcagatcacagcccaaaaagaagaggacaaggtaggtggaacgccaagcagagaacaagatgctgcccagaccgatggcctgagaaccacgacttcttaccaaagaaaggaggaagagtcggtaagaacgcagagctctgtgagcaaaagctacatcgaggtgagtcatggtcttggccatgttccccaacagaatggcttcagtgggacatctgagacagcaaacatccagaggatggtccccatgaatagaacggccaaacccttcccagggtctgtgaatcagccagctacccccttctcgccaacccgaaacatgacgagtcccattgctgactttcctgcacctccaccttactctgcagtcactcctccccctgacgccttctccagaggggtttcaagtccgattgctggcccagcacagccccctccatggccccagcctgccccgtggtcccagccagccttttacgattcgtctgagcgaatagcttcccgagatgagaggatctcagtgccagcaaaaagaacaggaatattgcaggaggccaaaaggagaagcacgacaaaacccatgtttacttttaaagagcccaaagtaagcccaaatcctgaactcttgtcactccttcaaaattcagaaggcaaacggggcactggagctggaggtgattccggaccggaagaagactacctcagcttgggggcagaggcttgtaatttcatgcaaagctcctctgccaaacaaaagacccctcctcctgttgctccaaaacctgcagtcaagtcctcatcctcccaaccagtaactccagtttccccagtctggtctccaggagtggctcccacccaacctcctgccttccccacatccaacccatcaaagggcaccgttgtctcctccatcaaaatagcccagccttcttaccctcctgcccggcctgcaagtactttgaacgtggctggtcccttcaaaggaccacaagcagcagtagccagtcagaattacacacccaaaccaacagtttccacaccaacagtcaatgctgttcagcctggtgcagtgggaccatccaatgagcttccaggaatgagtgggagaggagctcagctctttgctaaaaggcagtcgagaatggagaagtatgtggtcgattcagacacggtgcaggcccacgctgctcgagctcagtctcccactccatctctcccggccagttggaagtactcctccaatgtccgagcacctcctcctgtggcctataatcctatccactcgccgtcttacccactggctgctctcaagtctcagccatcagctgcacagccctccaaaatgggcaagaaaaagggaaagaaacccctcaatgcattagatgtcatgaagcaccaaccgtatcagctcaatgcatccttgtttactttccaacctccagatgcaaaggatggcctcccccagaagtcatcagtcaaggtcaattcagccctggccatgaagcaagctcttcctccccggccagtgaatgctgcctcacctacgaatgtgcaggcttcgtcagtgtactcggtaccagcctatacctctcctccttccttctttgcagaggcctcctcaccagtcagtgcatccccagtgcctgtgggcattcccacctcgccaaagcaagaatcagcctcatcatcttattttgtggcaccaaggccaaagttctcagccaagaaaagtggtgtcacaattcaggtgaaatgtaaatctgggatccatagtcaagatatcataaggacctacttcccagcctacctttcttcctctacctgataatgataatactcaaaataacaacattcaaaggaaacacaaagaaatcctgctttcacatctcctatttcttgggctccttaataactactgatggtttgttcatgaaaaaaaatttttaaatcaaaagattgtacttggccctgagttgaaaaaatttcaaaaatcaaaagtttgtacttggccctgagttg

SEQ ID NO: 3169 - DNA, 4728 bp, Homo sapiens
actgccgctgccgcggctacctgcggttcatctccgcacattccacacgcggcccaaacggtctctctctctctctctcaaacaccgcctttccgtctttgttttatcttgagtagcttagaaagattggagaagaaagcttacgtggaatgaaaatcaacttttatggatattttgaggactaaaagaataaatagggcgtccgtactgtagcgaaagtgcgactaaggttaggcatctggatttcccccgtagccctctttcaccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcaggtactaacttttgcgggggataccccaagatctctcagcgcccccgggtgggaggctgtggattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctctcaagctctcgcctttcctatcagcctgctgccctgggcgttggatcagctgacctggcttatccagtagtgtttgctgctggcttaaatgctacacaccctcaccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggagtcgcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgtactttacagcctcctgtcctgtaggttgtctgaagacctcgtaaccccttccccacccctgccccagtgcaggtctgggaaaggggagagtggtgcgttgtgaagcgcagaaagacctcaagtgtctgggcaagcctgttttgagtcgggtgtggcctcttaggggctgtataccctggggtttcctgggtcaggaaacttcttagtatttctctttccctggtcccctatcaggggcttgaatttgaatattcagttggagaatgcatttaaaatacacccatagtaaaatctccataaaatgc

SEQ ID NO: 3170 - DNA, 460 bp, Homo sapiens
acgctgcgggtcctgggcccaggccttgggatgggcgggaaggcttggccgcgccgggctgtgggcactgcaggaggcccctgtgcagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccg

SEQ ID NO: 3171 - DNA, 1199 bp, Homo sapiens
gctttgcaagttcttcaccgcaaagaactgccgcagacttccgcctgggtgccaaccacgtgatcacgcgagcgttggagaggccctaaattatacagatctgtgattgaagatgtcattaatgatgtgagagacatctttctggatgatggagtggatgaacaagtactgatggaactaaaaactttatgggaaaacaaactaatgcagtccagggcagtagatggatttcattcagaagagcagcagcttctactgcaagttcaacagcagcatcaaccccagcagcagcagcatcaccaccatcaccatcatcagcaagctcagcctcagcagacagtacctcagcaagcgcagacccagcaggttcttattcctgcatcacagcaagccacagcaccacaagttattgttccagattctaagttgatacagcatatgaatgcatcaaacatgagtgctgctgctacagctgctaccttagcactccctgcaggtgtgactcctgttcagcagatattaacaaattcaggccagcttcttcaggtggtcagagcagccaatggtgcccaatatatctttcagcctcagcagtcagtggttctacaacaacaggttataccacaaatgcagcctggtggagtacaagctcctgttatacagcaggtgctggctcctcttcctggagggatttcaccacagacaggtgtcatcatccagcctcagcaaatcttatttacaggaaataagactcaagttatacctacgacagtggcagcacctacaccagcccaagcacagataactgcaactggccagcagcaaccgcaggcccagcctgctcaaacacaagctccattggtcttacaagttgatggaactggggatacatcatctgaagaagatgaagatgaagaagaagactatgatgatgatgaggaggaagacaaagagaaagatggagctgaagatgggcaggtggaagaagagcccctcaatagtgaagatgatgtgagtgatgaggaaggacaggaactctttgacacagaaaatgttgttgtatgccaatatgataagatacacagaagtaaaaacaaatggaaatttcatctcaaggatggcattatgaatcttaatggaagagattatatattttccaaagccattggagatgcagaatggtgaagagttgctttttt

SEQ ID NO: 3172 - DNA, 5584 bp, Homo sapiens
gtcgtgctctcctcggtaggggaggaattggttaggcggcggcggcggcgaagcggcggcggcggctgtaggggagcagcggcagtggcggcgacggcgaggaggtgttcggtttgcgcagcgtagaaacgcccgcagcttcagagaaggagttcttgtgggaccaaattaggcattctgaacccacgccggcttagctgggccgagtccaggcgctgccgcacgtacagttttggtggcggtgacagacactgttcttgactctaggggcctattaggccgacgtctgaggcgcagatcgctggctctcgacgcattactctttacgccttacatttctgtcttccttcctgggtcagtgattcccggaccctggaagagaagagggtggctaatgattaaggctttccttaaagtttcccatgtctcaatggactcctgaatataacgagctctacaccttaaaagtggatatgaagagtgagattccttctgatgcaccaaagacacaggagagtctgaaagggatccttttgcatccagagcccattggggcagccaaaagttttcctgcaggagttgagatgattaatagtaaagtggggaatgaattctctcacctgtgtgatgattctcaaaagcaagagaaggaaatgaatggtaaccagcaagaacaagaaaaaagtctcgttgtgaggaaaaaacgcaaaagccagcaggctggcccttcgtatgtgcagaattgtgttaaagaaaaccagggaatattaggactgaggcaacacctagggacaccaagtgatgaagataatgattcctcttttagtgattgtctttcttctccttcatctagtctgcattttggagattctgatactgtgacttcagatgaggataaagaagtctctgtaagacattcccagaccattttgaatgctaaaagtagaagccatagtgcacggtctcataagtggcctcggactgagacagaatctgtatcgggattgttaatgaaaagaccctgtttacatggcagttcgttacggagacttccatgcagaaagagatttgtaaaaaataattcctcacagaggacacagaaacaaaaagagaggatattaatgcagaggaagaaacgagaagtgttagctcgaagaaaatatgccttgctacctagttctagtagttccagtgagaatgacctcagcagtgaatcctcttctagctcatcaactgaaggagaagaagatttgtttgtttctgccagtgaaaaccaccaaaacaatccagctgttccctcaggaagtattgatgaagatgttgtggtgatagaagcttcctccactccccaggttactgccaatgaagaaattaatgttacctcaactgacagtgaagtggagattgtaacagttggagaaagctatcggtctcgttcaacccttggacactccagatctcattggagccagggttccagttctcatgcaagtcggccacaggagccacggaaccgcagtaggatttctactgttatacagcccttgaggcagaatgcagcagaagttgtggaccttaccgttgatgaagatgaacctactgtagtaccaaccacttctgcaagaatggaatcacaagctactagcgcttccattaacaattcaaatccatctacctctgagcaggcctctgatactgcttcagctgtcaccagtagccaaccttccacagtgtcagagacttcagctactcttacaagcaatagtaccactggcacttctataggagatgactcaaggagaactacatctagtgctgtaacggaaactggccctcctgcaatgccaaggttaccttcctgctgtccccagcactcaccatgtggagggtcgtcacagaaccaccatgcattaggacatcctcatacaagttgctttcagcagcatggtcaccattttcaacatcatcaccaccaccaccatactccccacccagctgtcccagtttctccttcctttagtgatcctgcttgccctgtggaaagacctccacaagtacaagcaccttgtggagcaaatagtagttctggtaccagctatcatgaacagcaggcattgccagtggacctgagcaacagtggtatcagaagtcatggaagtggcagttttcatggagcatctgcatttgacccctgctgccctgtttcttcctcccgagctgcaatctttggccatcaggccgctgctgctgccccaagtcaacctttatcatcaatagatggctatggatcaagcatggttgcgcagccccagccccagccccctccacagccctctctctcatcatgtcgacattacatgccacccccttatgcctctttgacaaggccacttcatcatcaagcttctgcctgcccgcattctcatggaaacccccctcctcagactcagcctccgcctcaagtggattatgttattcctcatcctgtacatgctttccattctcaaatatcttctcatgcaacatctcatcctgtggcacccccaccaccaactcacttagccagtacagctgcaccaatccctcagcatcttcctcctacacaccagccaatttcgcaccatattccagccacagcacctccagcacagagactgcatcctcatgaagtgatgcagaggatggaagttcaaaggaggaggatgatgcagcatccaactggtctttttgtgttctgtgtttccaggcgggcacatgaacgccccccaccccatccacataggatgcacccaaactatggtcatgggcatcatattcatgtgcctcagactatgtcctcacatcctcgacaggctccagagaggtctgcctgggaactgggaattgaagctggagtgactgcagctacttatacacctggtgcattgcatcctcacttggcccattatcacgcacctcctcgacttcatcacttacaattaggagctcttcctttaatggttcctgatatggcaggctatcctcacatccgttacatttcatcaggattggatggaacatcattcagaggtcctttcaggggcaattttgaggaactgattcatttggaagaaagattaggcaatgtcaatcgtggagcatcccaggggacaattgaaagatgtacatatccacataaatacaaaaaggtaacaactgattggttctcacagaggaaactgcactgcaaacaagatggggaagaagggactgaggaagacacagaggaaaaatgtactatctgtttgtctattttagaggaaggtgaagatgtgagacgtcttccatgtatgcaccttttccaccaagtgtgtgttgaccaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgatgtatttataaaagcttttttttctagatttgacatttttctgtatcattttactgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcactgtctgtatgtggaggacatgttcccatggatcatatgtgaagatgtcaataagcttgcattaagccacctgctttgtaagtggattgattaataaataacttatatttctattgtctttgtgtttcataattagtttttataaaaacagtttacattaaacatcttggaattcaacaatagtgatctcactcaaattgacatttgcataatttgacatttatattcattcagttatgactacttgcccttttcttcatattagtaaatgttacactgtagtagttgtcaatgttaacaggcttcaacatagtatgtgtgcagatggacgatggatttaaagagcataccttatgattaaaccgaggttatagaaggtcaggggagagtgaaggagtcagtgacctatgtctgccatcttactggggaaaagagcaagtagcctgtcttcctttaagtaagtagcctgtaatggatgtactactttgccactggaataccccgggtctgtgccaagggactgaagaagtgtaagatggggagaactgtatgtcatggagtcctcttgacgttcccccagatacaagtaaagcacaggtggatttctctatttttgaatactacatcagatttagatgcacgactacctgttgacttgttttataattgctactgatttttttaatgtaggcaaagctttgttactttgaaatttatttaataaaagtatttgtgac

SEQ ID NO: 3173 - DNA, 3818 bp, Homo sapiens
cgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttggaggatttggacatcagcaattctcattctgccccgagctgcctattgctgagtcctggagaagtgcagttaagagatgggggccccttcttctactcagcccccacttgtggaacttgatcagaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcagtcattaagatcagatgcctatgatcactatagtgcaatctacagcctgctgtgtgatcgacataagagacataaaaccctgcgtctcggagcacttcctagcatgccccgagccctggcctttcaagcaccagtcaatatccaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagagctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgtaa

SEQ ID NO: 3174 - DNA, 1896 bp, Homo sapiens
atcagaccattgagatgtggaagctgttgctgtgggttggtgctgcccataaactcgtgtgttatttcaccaactgggcacacagtcggccaggccctgcctcgatcttgccccatgacctggacccctttctctgcacccacctgatatttgcctttgcctcaatgaacaacaatcagattgttgctaaggatctccaggatgagaaaattctctacccagagttcaacaaactaaaggagaggaacagagagctgaaaacactactgtccatcggcgggtggaactttggcacctcaagattcaccactatgttgtccacatttgccaaccgtgaaaagtttattgcttcagttatatcccttctgaggacacatgactttgatggtcttgaccttttcttcttatatcctggatttcatcaatgtcttgtcttatgacttacatggaagttgggaaaggttcacaggacataatagccccctcttctctctgcctgaagaccccaaatcttcggcatatgctatgaattattggagaaagcttggggcaccctcagagaagctcatcatggggatccccacctatggacgtacctttcgcctcctcaaagcctctaagaatgggttgcaggccagagcgatcggaccagcatctccagggaagtacaccaagcaagaaggcttcttggcttattttgagatttgttcctttgtctggggagcgaagaagcactggattgattaccagtatgtcccgtatgccaacaaggggaaagagtgggttggctatgacaatgccatcagcttcagttacaaggcatggtttataaggcgagagcattttgggggggccatggtgtggacattggacatggatgacgtcaggggcacgttctgtggcactggccctttcccccttgtctacgtattgaatgatatcctggtgcgggctgagttcagttcaacttctttaccacaattttggctgtcatctgctgtgaattcttcaagcactgaccctgaaaggctggctgtgaccacggcatggaccactgatagtaagattttgcccccaggaggagaggctggggtcactgagatccacggaaagtgtgaaaatatgactataacccctagaggtacaactgtgacccctacaaaggaaactgtatcccttggaaagcacactgtagctctaggagagaagactgagatcactggggcaatgaccatgacttctgtgggtcatcagtccatgacccctggagagaaggccctgacccctgtgggtcatcaatctgtgaccactggacagaagaccctgacctctgtgggttatcagtctgtgacccctggggaaaagaccctgacccctgtgggtcatcagtctgtgacccctgtgagtcatcagtctgtgagccctggaggaacgactatgacccctgtccattttcagactgagacccttagacagaatacagtggcccctagaaggaaggctgtggcccgtgaaaaggtgactgtcccctccagaaacatatcagtcacccctgaagggcagactatgcctttaagaggggagaatttgacttctgaggtgggcactcaccccaggatgggtaacttgggtcttcagatggaagctgaaaacaggatgatgctgtcctccagccccgtcatccagctcccggaacaaactcctctagcttttgacaaccgctttgttcccatctatggaaaccattcctctgtcaactcagtaacccctcaaacaagtcctctttctctaaaaaaagaaatcccagaaaactctgctgtggatgaagaagcctaagcccctctggtgtcagaaaccagggaaaacccttgtcttttcttctaagtgacatgttgg

SEQ ID NO: 3175 - DNA, 1572 bp, Homo sapiens
ctttccggcaggctactgggctccgcccacacacctcccggcctggttcctaaacgccagctcggagcaatccccttgggctggagccaaatccctgctgtgattttaaggaagaccggcagggtggcaaccaactatatctgaggaccagagccattttggggcaccagagcttgtgacctctccatctccacccagctgggtccaggggccactctcagcactcacctcagcagctgacatcataaagcagacttgggaacctggaagcactctggagaacctttccctgagacatggagctttggggccgaatgctgtgggccctcctgtctggcccagggaggaggggaagtacccggggctgggccttcagctcatggcaaccccaaccacctctggctgggttatccagtgccatagaactggtcagccactggactggggtctttgagaagaggggtatccctgaggcccgggaatccagtgagtacatcgtggctcatgtccttggagccaaaacatttcagagcctgaggccggcactttggacccagcccttgacctctcagcaactacagtgtatccgggagctgagtagccgtcgattgcagaggatgccggtgcagtacatccttggagagtgggacttccaggggctcagcctaaggatggtgcccccagtgtttattcctcggccagaaacagaggaactggttgagtgggtgctggaagaggtggcccagaggtcccatgctgtgggatccccaggcagccccctcattctggaggtgggctgcggatcaggagccatctccctcagcctgctgagccagctcccccagagccgagtcattgctgtggataagcgggaagctgctatctctctgacccatgagaatgctcagaggcttcggttgcaggacaggatttggatcatccacctcgacatgacctcagaaaggagctggacacacctgccctggggccccatggacctgattgtcagcaaccctccctacgtcttccaccaggacatggagcagctggcccctgagatccgcagctatgaagaccccgcggccctggatggtggggaggagggcatggacatcattacccacattctggccttggcaccccggctcctgaaagactctggtagtatcttcttagaagtggacccaaggcacccggagcttgtcagcagctggcttcagagccggcctgacctgtaccttaatcttgtggctgtgcgcagggacttctgtgggaggccccggttcctgcatatccggaggtctgggccatagcatggctgccctgtggatgccttgtcagtgccgccagcctgaccagaggggaggtggatggcactttccagagcccaggttcttatggcatttcccagggttctgtgatttccccatgctctgcatttctaggatatttctaggacacctggattggctccatcacatcagagtggctgagggcagttgctctgtgttggtgaaattgctgtgggggtatcgggggatatggccagtaaagtattgagagactaacaaa

SEQ ID NO: 3176 - DNA, 3307 bp, Homo sapiens
aataaatttctctgtgattggttggtgaaggttttcaaaccggagctgtgggcgcggcgctgctctgccgttgggtgaggcgcggagcgaagtgaagggtggcccaggtggggccaggctgactgaatgtatctcctagctatggactaaataatacatggggggaaataaacaagtattcatgagggtgaaaatgtgacccagcaggaaaattacaactattttcaattgacgttgaatagggtgagtaaattttagctttttgagttacaatttggctgagatatcagagttacagaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgctgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaaatgaa

SEQ ID NO: 3177 - DNA, 1968 bp, Homo sapiens
ccacccgcctctggctcctctccttcccacccctgccgtgctccggcaggaagaggtggtgccagggccgttgctaggatacgaccaacagctgagaacgcggcgagtatggaagctgcgtcttaggagcctgggaaagcacttcgacgagaatagtttggtttcgtacacaggaaaatgtctaatcaacaggagaagtatgaagctcagaatatagtcaattcaacagaagagagtgatgatgcttttgatactgtcactattccagttccctcagaagagcctcaagagtcagatcaaactgaagagcatgaatctggaatagaacaattcagtgagagccatgcaatacatgttgaggagcagagtgaccaaagcttttcaagcctggaaccagacaatgaacaactcatggaagaggttatatcaccaagacaagtttcatatactccgcaacatcatgaaaagcaatatgcaatgcagaggccaaatgatgatagtttggcatttctggataaaataaagtctgtaaaggaatctttgcaagaatcagtggaagattctctagcaacagtaaaagttgtacttattccagtgggccaggaaattgtaataccttttaaggttgataccattcttaaatatcttaaggaccatttttcacacttattaggtatcccacattctgtactgcagataagatactcaggaaaaattcttaaaaataatgagactctagtacaacatggagttaagccacaggaaattgtacaagtggaaatcttttctacaaatccagatctgtatccagtcagaagaatagatggattaactgatgtctctcaaatcataactgtcactgtccaaactggacttgatcaataccagcaggtacctgttgagattgtcaaatctgactttcacaaaccatttcttggtggattcagacataaagtaacaggagtagagtatcacaatgctggaacacaaactgtacctaaaaggattcccgaaagactcagtatattttgtagggatacgcagacagtttttcagaaaaaaaatctccaacaaactacaaatacaacatccacacagatgactaacattggtgtatatgtatcaaatatgactgataaactggtaacaccaggaaagtatttttcagcagcagaataccatgctcaaagactaaaggcggtgatagtgatacagacttactacaggcaatggcatgctaaaatcttcgtagagaatttaagaagacagaaaagcttaagactggaatgggaaacacagcaagaactaaggaagataagagaaaaagaagaatggataaaattggactatcaccggaggcataatcctaaaacaaatgaagattttgaatttctttataatgcattagaattctggcggcaagaagaacttacacgtattaaccaatcttttactggagctgaaaggaaagctgctctgtgtgaacttctggaaaaagagactcagataattgcttccattgggagacatagatacattgcttatatggcaaatcaggaagcagcaatacaagcttttttggataagtgttcagctccaaaaatatggagaacccctaatggcaaaacaattgagatggatacgcagttcaccatcagagccagagagctgcaaaatatctataagtgcattatgctgaaaaatatctcccaagatgagaggctggatgtgctgttaactcttaaacacactgtaaaggaacatgaatgtaaactaactcaggaaattctagaattgattgacagagaggttgaccttatgatgagaggagtcaaacatcataaccttgaaggactcagaaaaagaattgcgacactcttttttcattatatcaaaacacctctgtttaatcctgaagttgcaaaataccttaagatgggtggagaatatctttccatggcattatag

SEQ ID NO: 3178 - DNA, 1399 bp, Homo sapiens
ctctaggccacaatgtccaagtacctgggacagggtctggcttaccaacatggtacaggacggcacttttaaaaccagggactcgacttggacgtgcgagtcaacaaggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccacctta

SEQ ID NO: 3179 - DNA, 4329 bp, Homo sapiens
aagattatagagacttgctttagaaccacaagaagaaagaggaggccggcttttcagctagcatcatggcgtggccgtgcatcacgagggcctgctgcatcgcccgcttctggaaccagttggacaaagcggacatcgctgtgccgctggttttcaccaagtactcggaggccaccgagcacccgggcgccccgccgcagccaccgccgccgcagcagcaggcgcagccggcgctcgcgcccccctcggcgcgcgcggttgccatagagacgcagccagcccagggcgagttggatgcagttgcccgggcaacggggccagcgcctgggcctaccggcgagcgcgagccggcggcgggccccggccggagcgggccgggcccgggcctgggctccggctccacctccggccccgcggactcggtgatgcggcaggattaccgagcctggaaggtgcagcggcccgagcccagctgccggccgcgcagcgaataccagccctccgacgctcccttcgagcgcgagacccagtaccagaaggacttccgcgcctggccgctgccgcgccgcggggaccacccgtggatccccaagcccgtgcagatctctgcggcctcccaggcgtcggcgcccattctcggggcgcccaagcgccggccgcagagccaggagcgctggccagtgcaggccgccgctgaggcccgggagcaggaggcggcccccggcggagcgggtggcctggcggccggaaaggcgtccggggcggacgagcgcgacacgcgcaggaaggccgggcctgcctggattgtgcgccgcgccgagggcctggggcacgagcagacgccgctgcccgcggcccaggcccaggtccaggccaccggccccgaggctggcagggggcgcgccgcggcggacgccctcaaccggcaaatccgcgaggaggtggcgagtgcagtgagcagctcctacaggaatgaattcagggcatggacggacatcaagcctgtgaaaccaataaaggccaagccccagtacaagcccccagatgataagatggttcatgagaccagctacagtgctcagttcaaaggagaggccagcaagccaacaacagctgacaataaggtcattgatcgcagaagaatacgcagcctctacagcgaacccttcaaggaacccccaaaggtggaaaaacctagtgttcagagttccaaaccaaaaaagacctcagcgagccataagcccacgaggaaggccaaagacaagcaggcggtgtcaggccaggctgccaagaaaaagagcgcggagggcccgagtaccaccaagccagacgacaaggagcaaagcaaagagatgaacaataaactggctgaggcgaaagagtaaatttccctgcactttccttttactcttctctctctctccctccccccaactttttttttttaaaccaacaaaccaaaaaaggccacaaaattaattagaggcttctcatctgccttggtcctgagtgttccaggagctctttggtttggcttcttttgatggaagaatcctgcttcacagactgagtggcaggcctcctcctgagggcagcccctggagcaccaggaagcgttgccgctggctgtgccctcccctggcactctgactgcatgctgatgagcaaggcaggcaggtctgagaggcgaaacgaatctcccggcagtgcttggaagtgtctgtggggtctcctcctcccagatccccaagatctgtgtcactggtcgattttgaactttaggtacatgtgttcttttcaaaaattcagagaatcgtcatgtgccacagaagctcagcctgggcttcagcaattgacaaaatttgaagaaatattaaacaaaaataacaaaaaaagaaacaaccttggccttaatgtcaataaaagggagttgtgtctgttaagtggtcttttcatagaatcgtccattagaaatgtgtgcctgtgtttagcttcctatcagtgggctttaaattgtataccgagtcatagatacgccactgataactaaaactagatcagggctggtgaagaaggttaggtgttttaggtacattccagctgtcataggaagatcacagaaatgaggaggctgttttcctctgattctcctcggccgaccacctgtccaatgctgctggtttcgcagagcgaccggttggagatgtctgaggaagaaagttcaaggtgtagggatagtgtgtttggaatttgactttccatttctgagacccaagggggcgtagatgtagtggcaagtgtggcgatgtttactctcccttcctgaaccgctctggtctgctcctcagagagggcagcggtgccaggcctcaggtcagggagaatgtctgtgacttagctgcagactaggagactgccctgctaactaattagcaagcagctttgacctcattaatatataaaagcagctctcagtatattccgtgtcgtgtgtgtgtgtggccaaagcccccaagggtggcaagtgccaccttcgctgtgctagagttgtgttgtaggaattagtcagggagttgttgtgaaaaaaaaaaccccagtgcttgtgagggaactcaaaatagttaccagaaaaataatatttgccaatatgacgtgtatattgctcagcacactctgtatctcctgtccttaaaatcctcttgtccccggcattctgacacactgggctgccgtccggtgtcaagccccggcgcaggcttgctcttcttttacaatgaaaggggtgaagagtgagggtctcacagttccttacctcaaagtccctttaggtccttctggtttggaggaagtggagcctccacgaactctctcttactccgaccattcaggcagcaaagtctctgcttacatcattttggttgtcaccttggggctgagtgagaagtcttttgtaaattaattcggcgtgtgctacatgagccataattattaacagaacaggaatatcagaaacgaagttgttgatcaggcccactgcgaccttcctttctatctcagggtttaaaactgtgaggaaggagaagtatgaaggaaggtagaaaatgctggtgggtctccgtgtttatgagtcacagattttgaaagctatcaggaaatgactagagtggatcctggcactgattccaactctttgccagctaatcttaacatttagcagaaagctctagcaacatgatcttaattgtatccagaggatttgccaatgtatgttcagtctctcaagatttggcattagtcagacatgttgatgctagccacaatttggatttctccatagaataatcatttatttttgcagatcaaataaatcagagtttacaatgcacaggggatcatttatttagcattcccttgctagaagcccgtgtgccaggcactgtgctaggcgtggtgggcagtataaagaaatctgtctccacagccacacaaccagagggtgcacatgacttgatccctatgaccaagtcaagttggtgttgcccaaatcgcagtttgacataagggtcccacaggcttccccaccccccgcccccactcactgccccagggaccaacttcctaccctcacccaaggctttagaggacctgtagcatgtctttttcaacctgtcagtatccccttctgcttaacacacccactgagaaaaccctgtttgtagttcactttgactcttgaatgtgtcactttactggcaagagacttcctttgatttctactgtttacaaataaaactcagccagtctcattctatatcccaaacgtactgaatgaaactgattttggttccacaagcagtgtttgggtgttgccttcctgaaggtgaccaagcttccaaagctcgtcccactggcctctgtacatttccctgtggttctccgtccttccctggcgagggagctgggactgaagctttcccgctgtttccctgcctgcaaaagcagccccaagagctgcgcattggcttccctcagcaatctgtcctgtctgtgctcccattcggtccacatagctttctttgcctctctgaggcagacaggaagtgtctaattacgattttgtggcctgggttttgttgcataccacagattgtctatgtaacatgtagcgcacacctctcttggtgctatttcattcctgctgtaagagaatgacaaaaatattcatgtatagccaattgattgtgacgtgcttgtggtctgtgcttgctcagaaaaacaaacaaacaaacagtttttccaattataaataaatgctaaagacgaacacca

SEQ ID NO: 3180 - DNA, 1094 bp, Homo sapiens
ctcctggccacagcttgagctgggaggagggtggaggctgggccgcctcctggacccctgccctccctgcccggccttccaaggcccggcagcctcagtccactgctgggcctggaacacggagcagtggctgccctgcgaggaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggcctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggt

SEQ ID NO: 3181 - DNA, 582 bp, Homo sapiens; identical to SEQ ID NO: 3048

SEQ ID NO: 3182 - DNA, 2367 bp, Homo sapiens
acccttcgtagtccgatttgagcactaaaggttgctgactgtgtagtgggcaaaggatcaagtgatgccgtttcgcctgacacgttcacagctactccagcctgcaggagggaccttcccacccccaagacctttgtacttcgttctgtactgaagaaaccctctgttaagatgtgtctagagagcttacaggaacactgtaacaacctctatgatgatgatgggactcatccgagcttaatctcaaatctcccaaactgttgcaaagagaaagaagcagaagatgaagaaaattttgaagcacctgcctttctaaatatgaggaagaggaagagagttacttttggagaggacttaagcccggaagtgtttgatgaatctttgccagcaaatactccattgcgtaaaggaggaacacctgtttgtaaaaaagacttcagtggtctcagttccctgctgcttgagcagtcacctgttcctgagccattacctcaaccagattttgatgacaagggggagaatcttgaaaacatagaaccacttcaagtatcatttgccgttctcagttctcctaataaatcatcaatctctgagaccctttcaggcactgatacctttagttcttcaaataaccatgagaaaatatcctctcctaaagttggtagaataacaaggacttctaacagaagaaatcaattggtcagtgttgtagaagagagtgtttgcaacttattgaatacagaagttcagccttgtaaagaaaagaaaattaataggaggaagtctcaagaaacaaagtgtacaaagagagcacttcctaagaagagtcaggttttaaaaagttgcagaaagaagaaaggaaagggaaagaaaagtgttcagaaatctttatatggggaaagagacattgcttctaagaagcccctcctcagtcctattcccgagctgcctgaagtccctgagatgacaccttccattccgagcatccgaagactgggttcaggttatttcagttcaaatggcaaactggaagaagtgaagactcctaaaaatccagtgaaaagaaaggatcttttgcgtcatgacccagatttgcatatgcatcaaggctatgataaatatgatgtctctgaattctgctcttatataaaaagttcctcatcgcttggcaatgctacttctgatgaagatccaaatacaaatataatgaacattaatgaaaataaaaatattccaaaagcaaaaaataagtcagaaagtgaaaatgaaccaaaagctggaactgacagtcctgtttcttgtgcttctgtaactgaagaacgtgtggcatcagatagtcccaaacctgctctgaccctgcagcagggtcaagaattttctgctggtggtcaaaatgcagaaaacctttgtcagttctttaaaatttcaccagatttaaacataaagtgtgaaagaaaggatgacttcttaggagctgcagaaggaaaactgcaatgcaatcgtttaatgcctaattcacaaaaagactgtcattgtttaggagatgtcttaattgaaaatacgaaagaatctaaaagccagagtgaggatttgggaagaaaacccatggaaagtagcagtgttgtgagttgcagagacaggaaagatagaagacgttccatgtgttattctgatggtcgaagtttacatttggaaaaaaatggaaatcacacaccatcctccagtgtgggcagctctgtagaaattagtttagaaaattctgaactgtttaaagatttgtctgatgccattgagcaaacctttcagaggagaaatagtgaaaccaaagtgcgacgtagcacgaggctacagaaggatttagaaaacgaaggtcttgtatggatttcacttccacttccttccacttcccaaaaagccaaaagaagaacaatatgtacatttgacagcagtggatttgaaagtatgtctcccataaaagaaactgtgtcctccagacaaaaaccgcagatggcacctcccgtctcagatccagaaaacagccagggccctgctgctggttcttccgatgaacctggtaagaggaggaagagcttttgtatatctacacttgcaaatactaaagccacttcccagttcaaaggctaccggagaagatcctctcttaatgggaagggagagagctctctgactgccttggaaaggattgaacataatggagaaagaaagcagtaattgacatttcctgcagagtctgtggcaagagggaaagtaaccatctatgctgaaatgatctgtctagttcccattctctgttcaacctcagtgtttcaaaagttcctaataaataaactcatttgagttgaacct

SEQ ID NO: 3183 - DNA, 3652 bp, Homo sapiens
gtgcgcctgcgcgttggcggcggctgtggcggggcccggcggggagctccctcgcctggctctcggcggcctgatggagtaagaggggttggctgtgaatctgtgacgttgagtgcttcagatctggtcactatggtacgagaacgaaaatgcatattatgccacatcgtgtacagctcaaaaaaggagatggacgaacacatgcggagcatgttgcatcacagggaacttgagaacctcaagggcaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaagtgtggcagaaactcagactgtgatctcctccataaaaggatcaaagaattcttcagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtgagtcggaaatgtattggtgtctttgagggtcatacctccaaagttaactgcctcctggttactcagacctccgggaagaatgctgccctttacaccgggtccagtgaccataccatccgctgctataatgttaagagccgagagtgtgtggagcagttacagctggaagaccgggtcctctgcctccacagtagatggcgaatcctctatgcgggactggcaaatggcactgtggtcaccttcaacataaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttg

SEQ ID NO: 3184 - DNA, 567 bp, Homo sapiens
tggttggttttgttttgttttgtttttgaggacccaaagcatcagaattgtacaaactattctctttcctattgcattttcccttgagaacatgaactgacaaggaacaagcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaa

SEQ ID NO: 3185 - DNA, 439 bp, Homo sapiens
ctgcgaagagagcagaaggggtgctgctgtaggaaatcaatggctcggaagaccacactgaggaaggtgtgagttgatactggaagatctccaggtttgaggcatcttcagaggtatatggtggttttgtgtgtgttgagggtgtggtagcgcagcagctccctagggaattagaaggttttattgaacatttaccctgtgacaggcactgcaggcattcagcgcgcagtgtcatcttcattttacaggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagc

SEQ ID NO: 3186 - DNA, 519 bp, Homo sapiens
gtgacctcgaggcagcctcagcacggcactctcttgggtcctcttccaggctcacactgggcgacagcggagaggctcttggacggggcagagctcgcgccgagacctgcatgtccgcgtcttgtgacgggtgtgtgggaagccgcccgcctgtgcatcttgcttccgggtattcgctggctgatttactggttttagagatggggatgggcacccagtgctggactgaagaccagagaaggtggagctccctgtggccttggtctcacctctcttcagtcctcctggctgacaaggagggtgggccgccggcagtggacgaggtgttggatgaggctgtgcccgagtaccgggcgccggggaggaagagcctcttggagatccggcagctggacccggacgacaggagcctggccaagtacaagcgggtgctgctggggcccctgccaccggccgtggacccaagcctgcccaatgtgcaggtgaccaggctgacactcctgtcggaacaggctccgg

SEQ ID NO: 3187 - DNA, 2148 bp, Homo sapiens
ccggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaagacta

SEQ ID NO: 3188 - DNA, 1551 bp, Homo sapiens
aacctggccggcaatcagagaggatggggccactgctggtcgccctttctctcagagtaaaagtaattgtccaggagagtggtgtttgggtgtggaagggacgaagtctggctctgtcgcccaggctggagtgcagtggcacgatcttggcccactgcaatctccacttcccaggttcaagcgattctcctgcctcagcctcccgagtagctgggactacaggctcaggtggccttccttcagggagagaggaaagggcaggagaatctaaagacggacctggtgcggcggatcaagatgctagagtatgcgctgaagcaggaaagggccaaatatcataaactgaagtttgggacagacctgaaccagggggagaagaaagcagatgtgtcagaacaagtctccaatggccccgtggaatcggtcaccctggagaacagcccgttggtgtggaaggaggggcggcagcttctccgacagtacctggaagaggtgggctacacagacaccatcctcgacatgcggtccaagcgcgtccgttccctgctgggccgctcgctggagctcaacggggcagtggagccgagtgaaggggcccccagggctccaccaggccctgcagggctcagtggtggggagtcgctgctggtgaaacagatcgaggagcagataaagaggaacgcggcaggcaaagatggcaaagagcgcttgggcggctcagtgctggggcagatccccttcctgcagaactgcgaggacgaagacagcgacgaggacgatgagctggacagcgtgcagcacaagaagcagcgtgtgaagctcccatccaaggctctggtgcccgaaatggaagacgaggatgaggaagacgactctgaggatgctatcaatgagtttgatttcctgggctcaggagaggatggggaaggggctccagaccctcggcggtgcactgtggatgggagcccccatgagctggggccagagcttcacagccccacagagtggcagggggccctcagtgtggggaaggcgtcacctatgccagactgggttggaactgctgggtgactccggccctatgcctcgaccctgcagaaagccgtcgggtcaaactccaaggcattctggctgacctgcgggatgtggatgggctgcccccaaaagtgactggcccgcctcctggcacaccccagccccggccacatgaaggttcctttggcttctcctcagacgtcttcatcatggacactatcgggggcggggaggtgagcctgggggacttggcagatctcaccgtcaccaacgacaacgacctcagctgcgatctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcaca

SEQ ID NO: 3189 - DNA, 1869 bp, Homo sapiens
tttccggcggcgccgggcgagaagcgcgactggagtctggggctgcggcttcccagaggcgcgagtcgcttttccaggagccgaggcccaaacggggccgggcctgaagggtcccccgccagcccgcggccgcgccatcaatcgccgccgcctcgtcccgcttctcggctgaggcgccgcgcggccaggcagcgggtccaggcctcagccgcgcgcccaggggcctccggggccctcccgggtcagcatgcccggggtgaaactgaccacccaggcctactgcaagatggtgctgcacggcgccaagtacccgcactgcgccgtcaacgggctcctggtggccgagaagcagaagccgcgtaaggagcacctccccctgggcggccccggcgcccaccacaccctcttcgtggactgcatccccctcttccacggcaccctggccctcgcccccatgctggaggtggctctcaccctgattgattcatggtgcaaagatcatagctacgtgattgctggttattatcaagctaatgagcgagtaaaggatgccagtccaaaccaggttgcagagaaggtggcctccagaatcgccgagggcttcagcgacactgcgctcatcatgtgactactgtgaagactggccagaggcacagaggatctcagcctcgctcctggacagccggtcctacgagacgctcgtggatttcgataaccacctggatgacattcggaatgactggacaaacccagagatcaataaagctgtcctacacttgtgctaggcaggcaccgctgtgactgggctccgggcctttccactacgttgaagaagaaaacctatttttaaatgtaaataaaatatcttgtagcctgtgtggaaagctgaccgttttaagaagtggcatgtgccttgaaagggggcagaatgttcagtcggtcgtgtttttaacacagagtctctagaagaggtgcagacatcccgtctgactgtccctgtggactctctcagttgtatgttgctataatcctccaaatcaaagctctttctgcttgtgcaagattgttcctattaaacagttttaactaaccttttataatctggagagaatactttttaaggcttttgaactatctttttttaaaaaaaaaaaaaaaagcccacatcttatactccaatgagtgtgtttgtgagtttttatcctgtttgaattttgatgtcgtccaggcgtcctgggatcagggtagacacgtggagtgctggtgctgagctgtttgagaagctctgtgtgggtgtttctgtggtcaggtaggctgggctgtgaacagcactgctccacatggtgtcggctcacagagccaccgcaactctgcccagcgggagtgacaccactgatgccacagaagcctttatcgttaggggcaaaagcagacatctctggtagcaggagctcagtgtggtgctcttcagccacgcagaaagctcacgtgcctgcagggccaggaaagggaaatgatcgtttcttttgtattaggaaaaacaagacttagacttcccgagttgtgcagagtgacgtctgtactttttatacttagaacatttggtcaagttttgtaaccaaaccttagggaattgagagggaaactttatggtacgtttaccttttttcctttttatatgaattattttgtacaaagttcagagagcggtacctttcctactgtcttttctttgactccatggaggaatttgtaacgatcggtgtgacctgaaagggtttgtgatacagcggtcactattttctcttaacacataggaaaaaagttcagacatcgctacaataaatgtgctttatttgatccaccaaa

SEQ ID NO: 3190 - DNA, 699 bp, Homo sapiens
gtacgggagctggaggctgagcttgatgcagagcagaagaagcacgccgaggcccttaagggcgtgcgcaagcatgagcgccgtgtcaaggagctcgcataccaggtgggcgacagggtctccctggggagtggccctggagctggcccagcccaagcaagccctgagtcccccttgcccgcccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaagctatccctttctcctcagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctcca

SEQ ID NO: 3191 - DNA, 3714 bp, Homo sapiens
ttatcagagacattgagaggcaaattcggaaaaaagaaaacattcgtcttttgggagaacagattattttgactgagcaacttgaagcagaaagagagaagatgttattggcaaaaggatctcaaaaatcatgacttgaatgtgaaatatctgttggacagacaacacgagtttgtgtgtgtgtgttgatggagagtagcttagtagtatcttcatctttttttttggtcactgtccttttaaacttgatcaaataaaggacagtgggtcatataagttactgctttcagggtcccttatatctgaataaaggagtgtgggcagacactttttggaagagtctgtctgggtgatcctggtagaagccccattagggtcactgtccagtgcttagggttgttactgagaagcactgccgagcttgtgagaaggaagggatggatagtagcatccacctgagtagtctgatcagtcggcatgatgacgaagccacgagaacatcgacctcagaaggactggaggaaggtgaagtggagggagagacgctcctgatcgtcgaatccgaggatcaggcatcagtggacttatcgcacgaccagagtggggattccctcaacagtgatgaaggagacgtgtcttggatggaggagcagctgtcctacttctgtgacaagtgccaaaaatggataccagccagtcagctgagggaacagctcagttaccttaagggtgataatttttttaggtttacttgttcggattgctcagcagatggcaaggagcagtatgaaaggctgaagctgacatggcagcaagtcgtcatgttggcaatgtacaacttgtctctggaaggaagtggacgtcaaggttatttcaggtggaaagaagatatctgtgcttttattgagaaacattggacttttttactagggaataggaaaaagacgtctacctggtggagcaccgtggcaggttgcctcagcgtgggaagtcccatgtacttccgttcaggtgctcaggaatttggagagccaggatggtggaaacttgttcataacaagcccccaacgatgaaacctgaaggagagaagttgtctgcctctactttgaaaataaaagcagcctcaaaaccaactttagatcccatcattactgttgagggacttagaaaacgagcaagtcggaatcctgtggaatctgccatggaattaaaagagaaaaggtctcgaactcaggaagcaaaagacattagaagagcccagaaggaggccgctggctttcttgacaggagcacatcttctacccctgtaaaattcataagccgaggccgcaggccagatgtgattctggaaaaaggcgaagtgattgacttttcctccttgagctcctctgaccgcaccccgctgacaagcccatctccttctccttctctggatttctctgcccctggtacacctgcctctcattctgccacacctagcttgctttcagaagcagatctgattccagatgtgatgcccccacaagccttgtttcatgatgacgatgagatggaaggcgatggagtcatagacccagggatggagtacgtcccaccccctgctgggtcagtagcttctgggccagtggttggggtcagaaagaaggtcagaggccctgaacagataaagcaggaggtagagagtgaggaggaaaaacccgacaggatggatattgacagtgaagacacagattcaaacacatctttgcaaacaagggctagagaaaagaggaagcctcagctggagaaggacacaaagccgaaagagcccaggtatactcccgtgagcatctacgaggaaaagctgctgctcaagaggctggaagcttgtcccggtgctgttgccatgactccggaagctcggagactgaaacgcaaactgattgtcagacaagcgaaaagggataggggattaccactttttgacttggatcaagttgttaatgctgctcttttgttagttgacgggatttatggagccaaagaaggaggaatttccagacttccagctggacaagccacgtacagaaccacctgtcaggacttcagaatccttgaccgataccagacttccttgccgtccaggaagggatttcgacaccagaccaccaagtttttgtatcgcttggtaggatcagaagatatggctgtggaccagagtattgtcagcccttatacctctcggatcttgaaaccttatatcaggcgtgattatgaaacaaagccacccaaactgcagctcctgtcacagattcgttcccacctgcacaggagcgaccctcactggacgccggagcccgacgcacctctcgattactgttatgtgcggccaaatcacatcccaacgatcaactccatgtgtcaggagtttttttggcctggcattgacctgtctgagtgtctgcagtacccagacttcagtgttgttgttctttataaaaaagtcatcattgcctttggcttcatggttcctgatgtgaaatacaatgaagcttacatttcatttctgttcgtccaccctgaatggagaagagcagggattgcaactttcatgatctatcatctgattcagacctgcatgggcaaggacgtaacccttcacgtctcagcaagcaaccctgctatgctactgtaccagaagtttggattcaagactgaagaatatgtattagatttctatgataaatattacccattggagagtacagagtgtaaacacgcattctttctgaggctccggcgctgatgcgaatacagctcacagagaaacgcatgtgctattggagaacaggtctttgtggagatctaaaggcagtgattgatttcacagggagctctaatctctgtgattacatggtccttcaaactcccaaccaaagtgagaaaagcggcatgcagtgaaatgagcagtgagcagccctttagcaaaatcgccctccagtccttcctggagatgccttcagccagcatcccagactccacagttatttatgaatgatgtcgtgattctccctccacctgacagtttgtaagagtgaaagagcatctaacctgatgctcttggagagagataacctgtctgtcataacttaaaggatgagaaaatgtggtgtagctattaaagattcatgcagtcccaaaaggcactgtcctgggatgatgagagattataaggtgatttcataaaaggaatccaaccctgtgcccggccattgatgtgttgtcattgaatccaggaggatttctagggcactgaagttttgttgtttcttttgctgactttggttacagtcagaaaaaataaactagatgtttgtgtctacatgttctacctgttgtacctattagcatcttcctgcagggacttgggcccatggcctgggaggttggtttgggattggggttgttgggcagcctgccattcacctggcctatcctggcccttctcatgcccaagacagttgtttcacaggagtggaagtgtgggtgatgcaagtagaaccctctagatgtaccctgtgtggtctgcaggactggactgtttgctgtgtttgtggatgttggcgatagactgtcaattaggttgtttgtgatccaacaagaacatttccaaaagtatctaggtgttctcaaataaaaagctttctttgcacaacccatggccagagcgtcaa

SEQ ID NO: 3192 - DNA, 616 bp, Homo sapiens
agtgtaatcatcatctgctttccacatataaaaatcaccttggttatctatagttcaatcttctaaagccttcaagcctctgaaattcttcaaaattcagaagaagtagaaggaagtttttgatgatgagtgaggtggaggaagccatgcagtgtgtggaagagctgaatgcccagggcctactacatgtttttgtgagagtgggagtggagtccaccctggaaaggagccagatcaccagggatcacatgggccaattactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttgga

SEQ ID NO: 3193 - DNA, 582 bp, Homo sapiens
aacagaccgccgtgagagaggaggggcgccggccgggattcgcggcccggagctcgggaccggagtcaggaatggagagaagggtaatggtgttacctcttattgtggaaacctgttgagatcacagagaatatactgacggcataaaagggcagaaccatagcagggtgcgaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtg

SEQ ID NO: 3194 - DNA, 7211 bp, Homo sapiens
attcccctccacttcttgcctgagccgcctgctcctcttggaaacacgttgagcctccccgctggagagggagccagaacagggaagaacggattcacacaggatggcttgcagaagacgctatttcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccgggaagcgagggcgtcgcagcagtgcgggatcgctagagagcaatgtggaagggtccatcattagcagtcctcacatgcgccggagagctacatcaacacgagagtgtccatctcgcccacaccagactatgcccaactcatcttccctcctgggctccttattcgggagcaagagagggaagccccctccccaggcccacctgccctcagccccagccctgccacccccccacccaccggtggtcctgcctcacttgcagcactctgtggctggccaccacctggggcccccagaggggctgccgcaggccgccatgcacgggcatcacacccagtactgccacatgcagaaccctcccccgtaccaccatcaccaccaccaccacccaccccagcacatccagcacgcacaccagtaccaccacggcccccatgggggccacccagcctacggggcccatgcccacggccacccgccgctgccctcggcccacgtggggcacacagtgcaccaccatgggcagccccctgccccgccgccccccaccagcagcaaggccaaacccagcggcatcagcacaattgtgtagacagcctgggtaggggtcccaggctccctgaaacacctgcacaccacacagggcacgcccgggggtcgccagccgcacaccaaacccggggcacttctgttgccatctctcccctctgcccctcacggcccaaccggagccccaggagcccacagggctggtgttgtgtggaacaaaggcccagatttcatttcttgttggcaccctgggctctgctcacctcagtctgagggatgggtgggcctcagacaccatcagccttgaaacggtgagccagccaagtagtgttgaactgcctcccccactccagctctcagctccctgtgccctaatgtacatgcatatgaaaacccaacctagaaaacgaagaaatgagatacaaaaacagacaaaacaaaccccaaaacttgctgcattattgctcttttattgacaatgggcaaaaaaataagtagacctgatatggttgatgaaaatacgtaagtaaactttatataaatatataaatatataaatatatatatatatatactgtataggtagtacttgtgtgtgaaaggcaggcgtttcagtccacattagcaatacccaccttacaaggagctccacttacctaataggaagacagtaccttagctgggtgtgtgagacaatagaccaaaccctaaatgctaggaacaaattcagatacttcatattttcatacaaagaagtccctctaggactggctaaaatctttacacaatcattactaactgtgccaagtaacatagcatctaactgtttaaaaagtccagtattgctttgtataaatccttattttattaacagaatactatcataaatagtattataatgctgttatttcaggtaagcaaatagctaaactgcagtacactctacagtagcaactcaggacagctggttacaagctggttgtcttaggacattggttacacggattcttagacactttaatggctgcgataactgtgactctccatgatccatgtttcttttatgcgcatatgatttgacgcacactcattcagagtcctccgagaggggcacccatacacggcagaagtgttcatctccaacatgaaagtgaccagctctcatcctcgtctccccaacaccataacgtcctcatcccgcctccaacccacaccaggccgaagccctcagagagtgttttcatcaggaaccactctcgaacctgaaggttgactttagcgtttagcaacccagggcggtgtgtgtgtttcccgttttgttttctgagtggtagcagtgatcaccgtaattccatgtagccatgtgctagcagaacccctgtgtcctcaccgtggcccgtgtgaccccagccgacgagtgcccggcggagcccccgctgccttcccatggtccagtgagctgccagggcatcacatgactctcagctgtgctcttgtcgcttctgtgttgtggtgacaccatgcgctccccagggccagacctgcacgcggcaggtctgtgcccgagtcacccacgggccatactttgtagtttcagcctttcgagccactgcagccgtcagtgctgtgctcctaagccatgggacccgaggactgccccccggcgcctgcccaggcggaggccctttcagaaagggcgaagctcacgcctgactctgcgggccgcggggccgcgttcccagtggacagcgtggtgagccgtggccggacggcaggaggagaggggagccccctctggctgtgtgtcaccttggctggctggctggccagggttttgccgatttccctcctcacatccctcccaccctcggtcatatcattgagatcaccgtaccagcaaatctgcaaaccaagcactttgttaatctccagagagagcaaatacagcaatctagagtttagcctttttaaaaatgtgactttaacccgcccacctgtgtcctcccattggcgtggcatttctttggtgtctgctcagaaagaaacagcatgggaccgtgtgattgggtccaggctgggctgtcagggaagcgccctggtgtctccgactcatcaattctcgggtcttttttaaaagccaggctccccaaagcactctgtctcgcaattttgaggaggctgttccgacctggaagcgttaaactgctgcatgtcatctggcgtcagctgtgaggctgcgctctgcgtgttgtgcgtttgcaaaatgtattggcgtgactgtaaacacatcgttgaagtaaagcgattacatattgagtatgtcagcttttctcaccctcttctgtgctgggaggagagtctaactgtaacctttaggttgttccagaaaagattcaggccgtttggcacagaattgctctttctgaagggtagcagtaatgaataggaacagacagaaaaccccaggaggggctttcaggaaactctccctctccatcgccatcctgcaagctccacagcctcgggctgccagcctgtggcactgtcctcggtgtgtcctggagctgtgctgggcagcagggcctcgcgtaaggaactgctggaacccactgagcccttcccggggtttcccgccgcactcagtgtgttccttcaggctagtgaggtttcattctgttttatttgcaagcttatcaaaagtttgtggaagatacattgttgggttccagaggctggagtcatgctgcccacatcttgtttgggaaagcaaaagctcccagtgagctggtgtccccgtgtgtctttcatgggactgtcccctttagagatcccacctgtcagagccacagcttcggggtcctgtcatcacatcccctgggaggggaggcaggaggaggccgagggccccaggatgtctgcctggtcccttctcactgtgaggacgcccttggcacacctttctcaagtcacacaaattactgcagttacatacagaattgctgacaggagcaggagacgctgagggaaacagctggcaatgtgacaaaagtcttttctgggacaacaatcaaatcatgtatttgtatttttttaagtttaccaatgaattgtacaacaatgtaaaaataaagttcatcctaatatgctgtgcacatcttgcttaaaaatgtcttcagcacccagtgcagtgatctttccctcacacactgcatgcagcaggagcctcttgtttttcttaatgagctgaaaagacagcagatgttcacagctgatgctgggtgttgactcagcgccacgggaagctctgtgcccgcaggtaagcacgcacagtcttacagttctccttgtaaaatatcatcacccttcctgcctgagaaacgagtacatttgtattttatgtaacaacaatagtcaaggcagcattgcaacactgagcagggtgaggtgggggtgctgagcacaggacaagagggaggaggcctgccctccattcagatgcatctgcatcgcccttctgtgtgcagtcacatcgagactgcacacagcatgcatctcctcttggaaaatatcttttgcctccgagttgttttaagcaattagaatcaggtcctgaatccccagactgttcagagacttcaagggacacctccctcacaagaagcctggcacccccactgtgtacctttgagaggaaaggagtgcgtttgttttcatctgcattctgtttgtcagtggcaacagactctatcaatgtaaaaccatggttgtgatcatgtggggaaatcaaataaatcctttgaaactct

SEQ ID NO: 3195 - DNA, 975 bp, Homo sapiens
ggcgacgcctgcgcagtgcggtcgcggggctgtcgttgtcccgcgagccgccgaccaggcctcgaacgggatggcagaggaggtgagcaccctgatgaaggccacggtcctgatgcggcagcctgggcgggtgcaggagatcgtgggcgccctccgcaagggcggcggagaccggttacaggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcacacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctcatacacacatacaacaagaacagctctgcgtgtgagaactctggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaag

SEQ ID NO: 3196 - DNA, 1577 bp, Homo sapiens
gttgctccttcagcgcctatcgctggctcttggggcgcagagaggggccgcagtctccgcggctgcgtcgagctcccttgcagtcccctccatgttccccggcgccactactccccttcctaaggccgccgcttaccccggggtctatggaagtaatggaaggacccctcaacctgcatatctttctgaagccatgaagctgacacagtcagagcaggctcatctttcactggaattgcaaagggatagccatatgaaacagctcctcctcatccaagagagatggaaaagggcccagcgtgaagaaagattgaaagcccagcagaacacagacaaggatgcagctgcccatcttcagacatctcacaaaccctctgcagaggatgcagagggccagagtcccctttctcagaagtacagcccttccacagagaaatgcctgcctgagattcaggggatctttgacagggatccagacacactactttatttacttcagcaaaagagtgagccagcagagccatgtattggaagcaaagccccaaaagatgataaaacaattatagaggagcaggcaaccaaaattgcagatttgaagaggcatgtggaattccttgtggctgagaatgaaagattaaggaaagaaaataaacaactaaaggctgaaaaggccagacttctaaaaggtccaatagaaaaggagctggatgtagatgctgattttgtagaaacgtcagagttatggagcttgccaccacatgcagaaactgctacagcctcctcaacctggcagaagttcgcagcaaatactgggaaagccaaggacattccaatccccaatcttcctcccttggattttccatctccagaacttcctcttatggagctctctgaggatattctgaaaggatttatgaataattaaaatggaaggccacagaaaaggggaaaagaggaaataatacagtaatcgttaatccagcaaaaagaaatgaaaagggaaaaccacatagaagggtaatcccggaaatgcttcatctggtggactgtgggagcagaggcattgccaggacttgggaaacagtcactgtgaaatgcgctgcgtatctcattcactcacttcagctaatgattccgacttggcagacgctaaactcatggaggttcggtttctcctgatacaaaccaaatggctacctggaagaatttctttcaagcaacagttatttttcttatcttcagggttaaaatgtataaaagttatgtgtaattaatctataatgccataaatgataatgcaaaacctaaataatatggtggccggaggggctgccttatatttgaaacatgctttctatcatgcattgactgtatgcattttgttaatgcacattctgtttgtttaaggtgtgtaagatacacacccttctagatgaaactatatgtgccacactttgcactactcataatgataacctcaagactatcagaagaaatatttaaatttccattttatgaagaaaggaaccaaattattatgctttttaaaacaaattaccagtttacataattaatca

SEQ ID NO: 3197 - DNA, 390 bp, Homo sapiens
ctgtgcggctgcaggaacctaggaaataactcggaacctgtaacgtcccactggtttggacatattcctctcctgatctggcctcatctgttccagggaggtgggattgagcctagtgcaggctacagtcaaacctcttctggacttctgcgacagccttttatttggtttcttgccgctccttgacctctaacattctcgtctctgcactgcagctaacatgatcgtcaaacacaaatcagaacatatgcagtaatgtcacctcaaaagagagttaagaacgtccaggcacaaaacaggacttcacaaggtagtagtagttttcagaccacgctttcagcctggaaagtaaaacaggatccaagcaactcgaagaacatctcaaaacat

SEQ ID NO: 3198 - DNA, 1700 bp, Homo sapiens
gcggaaggggttcgcacgccaagaaccgccatgcctggggatcaccgccgcatccgcggccctgaagaatcgcagccgccgcagctgtacgcggccgacgaggaggaggcgcccggcacccgcgacccaacgcggctacggcccgtgtacgcgcgcgccgggctgctgagccaggccaagggctcggcctacctggaggcgggaggcaccaaggtgctgtgtgccgtgtcgggcccgcgacaggccgagggcggcgagcgcggcggcggcccggccggagcaggcggcgaggccccggccgcgctgcgcggtcgcctgctctgcgacttccgccgcgcacccttcgcgggccgccggcgccgcgctcccccgggcggctgcgaggagcgtgagctggcgctggcgctgcaggaggcgctggagccggctgtgcgcctgggccgctacccgcgcgcgcagctcgaggtgtcggcgctgctgctggaggacggtggctcggccctggccgccgcgctcaccgccgccgcgctcgccctggccgacgcgggcgtggagatgtacgacctggtggtgggctgcggcctcagcctcgcgccggggcccgcgcccacctggctcctggaccccacgcggctcgaggaagagcgcgccgccgccggcctcaccgtggcgctcatgcctgtgctgaatcaggtggccgggctgctgggcagcggcgagggcggcctgacagagagctgggcggaggccgtacgcctgggcctcgagggctgccagcgcctctaccccgtgctgcagcagagcctggtgcgggccgcccgccgcaggggcgccgccgcccagccctgaaccagaagcctgagcaactacggacgcaagccgaggaccgtgctgccgccgtccacgaaaagacccgcgccatcggcctccagtttgcgtcgagaattcctggaagggccctgatatgactgtggttggactgacctgactgccagatggtgggacttggtctggagcagggactacttggaatgataaaggcaaaactcaacagcccctggagctgcgcttgtggtggagctggaccctgaaattacctggaccttttttttagagacagggtttctttctgcagtctcaaactcctagccttgattgatcctcctgccttggcctcccaaagtgctgggactacaggtgcatgcaaccacacctggctaattttcttttcttctttctttcttttttttttttttttttttttgatggagtcttgttctgttgcccaggctggagtgcaatggtgcaatcttggctcactgcaacctctgcctcctgggttcaatccattctcctgcctcagcctcccaagtagctgggattacaggcacatgcctccataccgggctaatttttgtatttttagtagagatggggtttcgccatgtgggccaggctgttctcgaatgcctgacctcaggtgatccacccgccttggcctcccaaagtgctggaattacaggtgtgagccactgtgcccagctgagtaaatttcttgattgcacagaatgtacggtgatattggcggacttaaggacatcgaattgtttatcaggaataaagtattatgtgtgttttctgcggccctggataatgctgtagcattcagggtcgattgagtaaaaaaaatgtagagatgg

SEQ ID NO: 3199 - DNA, 710 bp, Homo sapiens
gctcgtccgctccctcccccgcgccgtgcacgtcttggttcgggccgggcataaaaggcttcgcggcccagggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggtatgagcaggggccaaagagggaggttgcagctaagctcacaccctcaggtcctagcagtgtggcttcgtggccattgctcaacctctggaacctgcgtttccccatcgtgaaaataatggaaacattgccgcccaagtctttaaggatgatgacagtaattagcatttgacaactagttgcctggtatatagagttgcagatgcaactcagatgcaactctatctactctatgtacttagttcccaggagggaggctgtgctgccctatttcatgaagatggaaactccagttcaccgaag

SEQ ID NO: 3200 - DNA, 1731 bp, Homo sapiens
agttggaagaggcgagtccggtctcaaaatggaggtaaaaccgccgcccggtcgcccccagcccgactccggccgtcgccgtcgccgccggggggaggagggccatgatccaaaggaaccagagcagttgagaaaactgtttattggtggtctgagctttgaaactacagatgatagtttacgagaacattttgagaaatggggcacactcacagattgtgtggtaatgagagacccccaaacaaaacgttccaggggctttggttttgtgacttattcttgtgttgaagaggtggatgcagcaatgtgtgctcgaccacacaaggttgatgggcgtgtagtggaaccaaagagagctgtttctagagaggattctgtaaagcctggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatgatcatgatacagttgataaaattgttgttcagaaataccacactattaatgggcataattgtgaagtgaaaaaggccctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggtaggtatctttaaatttttattatgatgataaaagaatatgtggaactgttcactgagtgtaataatttttttatcctgtattattcaacaggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaag

SEQ ID NO: 3201 - DNA, 319 bp, Homo sapiens
tatccatgagcagtgggaaaaggctaatgtaagcagtccccaccgggagttcccccctgctaccgccagagaggtggacccactccggattcctccacaccacccacacaccagtcggcagcctccctggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggc

SEQ ID NO: 3202 - DNA, 647 bp, Homo sapiens
agtggcaagcgcgggcaggaccgcgttgcgtcatcggggcgcgcgcctcagagagagctgtggttgccggaagttgagcggcggatccaattcctgtatcttcaccttgtctaccgggatttctagagcagccttgtgagagacatttctgagacctgtatgtcctgcgtctatgattcttccctgatcaaggcttctcaaaccccataatgctggtatccagtgcatccgttctcaaaaactgaagctgatggacaccagattgcatgtgaaggtgaaggatattatagcagaaggaaaccaaaataaaagaaaaacagctcctggaagtaaccaatgagaaggacagataagagtttgaagactgtggatgtgactgcttgttccctggttgacacactgaagaagaaatcatgttgattcagagttggcttggaggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagt

SEQ ID NO: 3203 - DNA, 2595 bp, Homo sapiens
acttctcaattctttgttctgtgaagtggttgtcactattgttcccattttacagatttgaggaactgataccccaagaccccgtgactttctcaaggccattccaagatccctagatgcacttacgcttaatgaactaattcttcacagcgaggcttcttgcttaaaatccaagaaaataccagataaagggcattctaaatatatttcttttctatagatgtggatctcctgttactggaaaacaggaattagcttgtctgcttgaggatgtggttggttctttataaaaaggatacagaagaaatttgcacagactgccagcttcattatgctgccgacagcttccagcaaaaggaggacgtttgcagccagatatttcacccgctccaaaagcctagtgatgggggagcagagccggagccctgggcggatgccgtgccctcacaggctgggccccgtgctgaaggcgggctggctgaagaagcagaggagcatcatgaagaactggcagcagcgctggtttgtgctgcgtggggatcagcttttctactacaaggacaaagatgagatcaagccccagggatttatttctctacaagggacacaggtgactgaacttcctcctggccccgaggacccagggaagcacctctttgagatcagcccaggtggtgccggggagcgggagaaggtgccggccaaccccgaggcgctcctgctcatggccagctcccagcgtgacatggaggactgggtgcaggccatccgccgagtcatctgggccccgctgggcggagggatctttgggcagcgcctagaggaaacagtccaccacgagcggaagtatggcccccgcctggcgcccctgctggtggagcagtgtgtggacttcatccgggagcgcgggctcactgaggaggggctgttccgcatgccaggccaggccaacctggtgagggacctgcaggattccttcgactgtggggagaagccactgtttgacagcacaacagacgtgcacacggtggcctccctgctgaagctgtacctgcgggagctccccgagcccgtggtccccttcgccaggtacgaggacttcctcagctgcgcccagctgctcaccaaggacgagggggagggcactctggagttggctaaacaagtgagcaaccttcctcaggcaaattacaacctgctcagatacatctgcaagtttctggatgaagttcaggcatactcaaatgtcaacaagatgagtgtccagaatctggcaaccgtttttggacctaacattctgcggccacaggtagaggacccagtaaccatcatggaaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggaccaggaaaagaaaaaatacatcatgctggaaataaagctgcggaactctgaacgggcgcgggaggatgcggagaggaggaaccagctgttgcagagggaaatggaggagtttttttcgaccctaggaagcttgactgttggggcaaaaggtgccagggccccaaagtaaaaggaatggcagagctcacttctgtaccacgtctgctggtctccagccttgtatggagttagaagcgtctgtatctctggagcagccaggcgctctggagccagctggagagagagagatcctgatacctctgtggggactgtggggac

SEQ ID NO: 3204 - DNA, 890 bp, Homo sapiens
taggaattagggcagagttaggagcggcctgcggaggggcccgctcaggccgatgccggtagtggaaacagaggaagccaccgccgcgctcttctcggaactggctaaaatagctccgtaaatgggccgagcgcaacacggaggggataccgctcactaccaggttcccgaactttggcttaccctcagcttgagccagcgcacatctcctccttaacagcctctcctgagaataggctggcttcaagggaatgggggaagtgaatgatctcaaactacagaaatggcagtgaacttgtctgtttcaattcgggagtgggctgcttcctgattggctgtgattgggctttcactgtgcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagctggacctggcggtccctttctgtgtgaacttccggctgaaagggaaggacatggtggtggacatccagcggcg

SEQ ID NO: 3205 - DNA, 1811 bp, Homo sapiens
agacggcagggcttaaagttccgggaatcaaagatcaactcccactgaggacaaatggacctgtaattccgggtgtgacgagagaacgagatttaccttcctgaattaaaaaacagactccctgcgacaaggactgtgtactgcatgaatgaggctgagatagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatgcgtaagttgtgctaatgtctttccaagttctgggttgggaagtggagggtggcagcgtttgtttgtgtgcagccgtccagtcctgttcacagcgaggatttggagtcctccagggtctcatcatgggagtgatttgtcagcggacgcctctgccctgtctggcttcaggtccagggaagctttgaagcagtcaagccttgtctttgtaccccatgtgtcctgtctttgttgagtcactcagagatcactcctggacctctggggttggagttccagtgatggcttatggcggcccactcactatggtgggctgagtggaagctccttaaccatgtccccagagacactgaggtgctcgctcttttaatgtcctcgtttgttgccgtaagttctttgctaggtttcattttggcatttggcaaatcagcctggaagtctggccccatgacagcaatcactccctccccaccctcctgaagctagaggaagatttgctcagatccattaattaaagcaggaattggtgtgacaa

SEQ ID NO: 3206 - DNA, 434 bp, Homo sapiens
tgatacaatctggtgattcccgagcatacacatcatattttatccccattttgccaatgaggaaactgagacccagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccgg

SEQ ID NO: 3207 - DNA, 333 bp, Homo sapiens
acggggctctgggagtaagcctgtctgcctggcgggccttcaggtgcggcgtgagagatggatgccaattcaaaagacaagccccctgaaaccaaggagtctgcaatgaataatgctggaaatgcctctttcattttgggaactgggaagattgtgactcctcagaagcatgccgaattacctcctaatccttgcacaccagatacttttaaatcacctttgaacttttccacagtaaccgtagagcaattgggaattaattgacatttcctgcagagtctgtggcaagagggaaagtaaccatctatgctgaaatgatctgtctagttccca

SEQ ID NO: 3208 - DNA, 1001 bp, Homo sapiens
cggagacggtggagtctccgcactgtcggcggggtacgcatagccgggcactaggagctttctcttgcataccctcgcttaggctggccggggtgtcacttctgcctccctgccctccagaccatggacggctccttcgtccagcacagtgtgagggttctgcaggagctcaacaagcagcgggagaagggccagtactgcgacgccactctggacgtggggggcctggtgtttaaggcacactggagtgtccttgcctgctgcagtcactttttccagagcctctacggggatggctcagggggcagtgtcgtcctccctgctggcttcgctgagatctttggcctcttgttggactttttctacactggtcacctcgctctcacctcagggaaccgggatcaggtgctcctggcagccagggagttgcgagtgccagaggccgtagagctgtgccagagcttcaagcccaaaacttcagtgggacaggcagcaggtggccagagtgggctggggccccctgcctcccagaatgtgaacagccacgtcaaggagccggcaggcttggaagaagaggaagtttcgaggactctgggtctagtccccagggatcaggagcccagaggcagtcatagtcctcagaggccccagctccattccccagctcagagtgagggcccctcctccctctgtgggaaactgaagcaggccttgaagccttgtccccttgaggacaagaaacccgaggactgcaaagtgcccccaaggcccttagaggctgaaggtgcccagctgcagggcggcagtaatgagtgggaagtggtggttcaagtggaggatgatggggatggcgattacatgtctgagcctgaggctgtgctgaccaggaggaagtcaaatgtaatccgaaagccctgtgcagctgagccagccctgagcgcgggctccctagcagctgagcctgctgagaacagaaaaggtacagcggtgccggtcgaatg

SEQ ID NO: 3209 - DNA, 620 bp, Homo sapiens
ccttctctcttcctcggcgctgcctacggaggtggcagccatctccttctcgcttgctccgtagctggcgattggaagacactctgcgacagtgttcagtccctgggcaggaaagcctccttccaggattcttcctcacctggggccgcttcttccccaaaaggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactg

SEQ ID NO: 3210 - DNA, 1709 bp, Homo sapiens
agtgcctgcggccctcggcggcctagtacacacgcacctgagtgagtggcaccagaggaccctctccatgtttagggacctcctgggcctcaggagcgtggcgcccgcccctgggcggactccccccatccgcgggcgcgaatggtccgggccgcgtccgcagtgctgctggctgctccctggttgctgggtgcaaagtgctgggttctgggtttctggattcgcgggccgttcacacgtagcctgtgccggctcctcggatgcaccgcgcgcccccgcgccctcaccgacgggtccagacctggtgggaagaaggtgcggggacgggtccctgaggatcccgatgcctacgagccaagatgctcagctttataggtgtgacctacacatgtgacttcacctcagttttgtgatccgtaaaatggacaaattcgaagctacttcacagtgctgttgagaggattaaatgaaacaatgcttgtaaagctctttgcaggagggagcctcggaagcagggcctggccggcagagcacacctgctgtcaccagggaccacaggcagcatgaagacccccgtggagctggccgtcagtgggatgcagaccctcggccttcagcaccgctgccgaggtggctaccgggtcaaggccaggacgtcatatgtggatgagactctgtttggcagcccagcaggcacccggcctaccccaccggacttcgatccgccctgggtggagaaggctaacagaaccagaggcgtgggcaaggaggcatcgaaggccttgggggcaaaggggagctgtgagaccaccccctcaaggggcagcacccccaccctcacaccaaggaagaagaacaaatacagacccatcagccacaccccgtcttactgtgatgagtcgctgtttggctcccgatctgaaggcgccagcttcggggccccgcggatggcgaagggggatgccgcaaagctccgtgctctcttgtggacgccaccacctacccccaggggtagccactcgccccgccccagggaggcaccactgcgagccattcacccagctggtccctccaagacagagccggggccagcggcagactcccagaagttatctatgggtgggttacactcttcacgccccctgaagcggggactttcccattccctcacccacctgaatgtccccagcactggtcatccagccaccagtgccccccacacaaatgggcctcaggatctcaggccttccacgtcaggggtgaccttccggagccccctggtgacttccagggctcgctcagttagcatttcagtgccatctaccccacgacgaggtggggccacccagaaaccaaagcccccttggaaatgatactctttcatcagggttgcctatggggccacggcgacaggtatggccccttgccagggtaggaggacattcatcacccagggaaccccaggtattaaagaagcccctgtgggggcagacagacatagcaggggtgggcagtgcctccctttatcctgacaatctctagtcgattcttgcctttttctcccgattgcggatttgggggccacctctaagatgcctctctccagccctgtctcaaccatactccaaattagtgccaacccaggggcctggcacctcccacatcatccattgtcttgctgccaagtgcgaataaacggcgtgattgcc

SEQ ID NO: 3211 - DNA, 1732 bp, Homo sapiens
agctggccgggacccgggcggagcgggcggggacccgggctactgcggtgtggactcgagggctgggcgcggggccggcgcagaagccgccagctggagacgatggtggaccacttggccaacacggagatcaacagccagcgcatcgcggcagtggagagctgcttcggggcctcggggcagccgctggcgctgccaggccgagtgctgctgggcgagggcgtgctgaccaaagagtgccgcaagaaggccaagccgcgcatcttcttcctctttaacgacatcctggtgtatggcagcatcgtgctcaacaagcgcaagtaccgcagccagcacatcatccccctggaggaggtcacactggagctgttgccggagacgctgcaggccaagaaccgctggatgatcaagacggccaagaagtcctttgtggtgtcggccgcctccgctacggagcgccaggaatggattagccacatcgaggagtgcgtgcggcggcaactgagggccacgggccgcccgcccagcacggagcacgcggcaccctggatccccgacaaggccacggacatctgcatgcgctgcacgcagacgcgcttctctgccctcacgaggcgccaccactgccgcaagtgcggcttcgtggtctgcgctgagtgctcgcgccagcgcttcctgctcccgcgcctgtcccccaagcccgtgcgcgtctgcagcctctgctaccgcgaactggccgcccagcagcggcaggaggaggcggaggagcagggcgcggggtccccagggcagccagcccacctggcccggcccatctgcggagcgtccagtggagatgacgatgactccgacgaggacaaggagggcagcagggacggcgactggcccagcagcgtggagttctacgcctcgggggtggcctggtctgccttccacagctgacccccggcctgcagaacatctgtccccaagccagctccactgcccaggcccccaagagggcagctccagaagctgcccagggctccgggaccccatcccatggtggcaggtgcagcggtggggagtggctctttctggactcccagtgcctttttgctggacactgtgtccttatggcttcactgcaggtaatgcctttcccttcaggaagccccagaacacccacaggtcttggtaacaaacgccaccttacactctgcaggctgcagcggcagctccagatggcctcctgagctggacgaccccaggtctccagacatctagggaccagagcaggtttgggaacacagagggaagacaggatgggagtgtagccacagaacccacctgcaccctgacaggcacaccccactgaagagcctgagtcccaggaggcctcctggaagcccaggactgcccacccaccacgctggtgcccaccgcctggccagccaagccctgccgatcagacatgtgggctccccgaagcccagccagagactgccgtgctgtgggtgccaccaggcccagggactgcagcctgagctccccgaggcccagggcagccgggtgaggactctgtcctgtgtcacctctctccaggtgtccagctgtctcatgcctttttgtcctgtcctcagctctccgtgtggtcagcgaaaccattgttttctgttaggactcagttgcaagaacagaaaccctgcccccacttaataataaaaaagaaagtttattgatgggtggttgc

SEQ ID NO: 3212 - DNA, 274 bp, Homo sapiens
tagaagttctacaagtccatgtggcacatccaagagtccaaacagagagtgggaaggaaaatcagtcgcctatatgccttatgctgaggtcaaacgtgctctagaacaggaagcacagatgcacaatactgcagcaaggtcagcctcaccgtgtaggctttctccaagagaagtcagtaaagccgctccacagcctgatatgagtgcagcccgctatagtgtcccgccagtccttcagcctgctccacatcaagtgataactaatctccctgaa

SEQ ID NO: 3213 - DNA, 3101 bp, Homo sapiens
gatgagacatgacaaagctggctctgggaagcatgccctacctaggaccctgccctgtggcccagggtgtcgtccggcccacttgcagtcttaatctctgaattctgggccctggaacaggctgtgtctagttctcatttgccgtactcaccgggcccctttacatactctactttctctttccctctgggtttgagtgctagtaaccccaggctcgtgtgtccactgctgtcatgctgctgtgggacttccggcctctgagccagtctggtcacctctctgtgactcccttagaggaggctctggatgcttttacagggttaaatgataccacaagaggcagggcagcgggctcgacgagctctgttctggtgcgggcaggaggcgggagcccggatctgtgcgactgaaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgcactttggtgtcactgtctcaagcacttcctaatattcactagtttgaactctgaggtaggtactttttttttttttgagatggagtctcatactctgttgcctaggctggagtgcagtggtgtggtctcagctcactgcagcctctgcctccggggtgcaagcgattctcctgcttcagcatgcctgtagctgggactataggcatgtgccatgaagcctggctgatttttgtaattttagtagagacggagtttcaccatgttggccaggctggtctcaaactcctgacctcaggtgatacacccaccttggcctcccaaagtgctggggttacaggcgtgcgcgctctaccgaggtatgtacttttgtctccactaggtaagcacacgtgcaaagtgaggcccgggagtaactgcccaaagcaactgagccgttcagtggcagagccaggggtctggacctaggtcccagctacacgccttgcccctacccaagttcccctaaggacgatgatggaaataagtcaccctgacacatctcagttcatcttcctcaaaactatgcgagatagcctaggactggagcgaggagaggaaaaggccttgttctctgaagtagtggtgccagcttcctgtagcactcaagacgtctgagcgggaagcaaatggttctcgaagcaagcaaggctgtttggaggccctaccctcagtctgaggagaacataccaggtccctccccagcaagaatgtctcaccttgacacaagcccagcttccctcccctctgccccagaccctagaataagacaggacaagt

SEQ ID NO: 3214 - DNA, 3318 bp, Homo sapiens
gggagattacggggcggggacgagctgtcgcgctggttgctcgtgcaggagcgggacccggaacagaccgccgtgagagaggaggggcgccggccgggattcgcggcccggagctcgggaccggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccctagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttataagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 3215 - DNA, 1054 bp, Homo sapiens
gacaacaagatggcggcgctgcgggacggctagcggccctgcgtggaggcgaggaatccgcatctatggagatgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgataagctgctcctcaaaccacacctttggggattttgaagggagtggggatacacagcctccccagacacctcccattctgaggggaagccgctgcactccctgggggaccccagtctgatgccctccaggaggataagtctgaagccgggctgggaagggagcggagaggcccgaaacagagcagcaggcagcgccctctgctggcaccctggagacagcctcggctgcggggcccctgccttctagtcctccccagctttcaggacaccttgacaacctggggtccctgcagaagtggcccggctgtcccccaagtctcctg

SEQ ID NO: 3216 - DNA, 3533 bp, Homo sapiens
gttgcctgatgacgagagttgggagtgtggctggggctgcggatctccagcagtggcgttacttctagcggctggataccgggttctccgcgagatcgcgagatcccgagatattctccccgcacggaagcgacgactggcctggccagaggactcgcgtgggagcgaggtgccggccccgacaggacggtgagaaattgttttacagcctacccgtatattacaagaaatctcaagtcaaacactggaaaagatgtcagaagattcagaaaaggaagactattcagacagaacaatcagtgatgaagatgaatcggatgaggatatgttcatgaaatttgtaagtgaagatcttcatcggtgtgcacttttaacagctgactcttttggtgatcccttcttcccccggactacacagatactattagaatatcagctagggagatgggtgccacgtcttcgtgaaccaagggatttatatggtgtctcttcttctggtccattgagcccaacacggtggccataccattgtgaagtcatcgatgaaaaagtccagcatattgattggactccttcttgtcctgagccagtgtatatcccaacgggcttagaaacggaacccctttatccagactccaaggaagctactgtggtttatctagctgaagatgcttacaaagagccctgttttgtgtattcccgagttgggggtaaccgaacacctttgaagcagcctgtggattaccgtgacaatactttgatgtttgaagcaaggtttgagagtggtaatctacagaaggtagtcaaagtggcagaatacgaataccaattgactgtacgccctgacctcttcacaaataaacacacccagtggtactatttccaagtcactaatatgcgagcaggaatagtctacagattcactattgtcaacttcaccaaacctgctagtctttacagtcggggtatgcgcccactgttctattctgaaaaagaggccaaggctcatcacattggctggcagagaataggagaccaaatcaagtattataggaacaacccaggccaagatgggcgccattatttctctcttacatggacatttcaatttccacacaacaaagatacctgctactttgctcattgctatccatacacttacaccaacctgcaagaatacctttctggcatcaataatgatccagtacggtcaaagttttgtaaaatacgtgttttgtgccacacgcttgctaggaacatggtgtatattttaacaatcactacccccttgaagaactctgactcaagaaagcggaaggctgtgattctgactgcaagggtccatccaggggaaaccaacagctcttggatcatgaaaggcttcctagattatattttaggaaactcaagtgatgcacagttgcttcgggacacttttgtcttcaaggtggtacccatgctcaatccagatggtgtgattgtgggaaattatcgctgttccttagctggacgggatttaaaccgtaattatacatctctcctgaaggaatcttttccttctgtatggtatacccggaacatggttcatagactgatggagaaacgagaggttattttatactgtgatcttcatggccatagtaggaaagagaacatcttcatgtatggctgtgatggtagtgacagatctaagacattatacttacagcaacgaatcttcccacttatgctaagcaaaaattgtccagataaattttcattctcagcttgcaagtttaatgtccagaagagcaaagaaggaacaggaagggtggtaatgtggaaaatgggaatcaggaacagctttaccatggaggccaccttctgtggatctactctgggtaacaaacgaggcactcatttcagcacgaaagacctggaatcaatgggatatcatttttgtgattctctcttggattattgtgatcccgaccggaccaagtattatcggtgcctgaaagaattagaagaaatggaaagacatataaccctggaaaaagtctttgaggattcagacacacctgtgatagacattacattggatgtagagtctagtagccgaggctctgacagttcagaatccattgactctctgacttaccttctcaagttaacttctcagaaaaaacatttgaaaacaaagaaggaaaggaattctaccatagcaagccaccaaaatgccagaggacaagaggtttatgatagagggcatttgctgcaaagacacacacaatcaaattctgatgtgaaagatacaaggccaaatgaaccagatgattatatggttgattatttcagaagacaattacctaatcaaggtttggatctgcaccacaacttaaaaagcaaaataaaagaatgcatatctttccaaagcaagaagactggcataaattggacagatgatgaaaaaagaagctacaaggataaaggaatagttcaaactcaagaaatattgcagtatttgctccccatcgtgcatagcactaaaaacatgcaaaccactcagataaaacagctattcaatccaagaaccaacttccaaatccaacatcaactaaatccggctacttgcagaaatataaagaaatacagcacatcttggacagcacccagaaatcacccttttgtaatccaaggggatgttatggcaaactcttcagaatgggtccagtctaagccccacaggtcattggaaagtttatcacctctcaaaggccccaagaagaataaacattctcaaatctgggccataaagaatgaagacataaaacctctcagcagcaagtgggagactgcttcttcaagctttggaatggatgcaaatgttctaaaatataagagtcttcaagctgaagaaactaaccagcaaagctctaagcatacagccctccatctaactaaaaataaggatgagcaggccaataagaatgatggacaacccaccttatatctgaagttccaaagggagagttaatctagctttatactgctctgagaactgtgaatgaaggataacatatgcttatgtagtaaaaagaaaaaaaggaaagccctccccttcccctttccctatctctccccttacacatgcatatgcataaactaaaaattttagatatcccatcttctgtagtgggaacatctttcagagatttaaaaagaaatccagagaaaatatggaaaaatattaaagcagatatttatatttagtttttatcagcatggaaaaaaatctctgaagttttgatttcttccaaaactacttacacattcgacaccaaaaaaacttaagaactcaaagtaggaatgacatataatatgtcactgattttaacctccctactagacactttaatcaattagtcaacaaacatcatttcctgattttctgttatatcattagtgtgctaggaaccatttctctctactaggagattaccacataattgtacagataaaacatacctgaataaaatgattacagaataaga

SEQ ID NO: 3217 - DNA, 1487 bp, Homo sapiens
taacaacggctacattcctcccccagggccaagggaaatcctgagcgcaggccagggttgtttggttttgaggtgtgctgggatgaaaggcaccctggaagtggaaggttcggtcattcattaattaattacatctataattgagggtttgttcttaagagcgagtcctttgaaagtactttccttcaaacagtgactgccacaaaggcatcagatattcaccaccttctcggctgcctcagcacagcaagctttattctgggacctgagatcctgttctgagctggctttcccttctccaggctcgctcaccctccctttagagatagtggatggtaagatgaccaatgctcagattattcttctcattgacaatgccaggatggcagtggatgacttcaacctcaagtatgaaaatgaacactcctttaagaaagacttggaaattgaagtcgagggcctccgaaggaccttagacaacctgaccattgtcacaacagacctagaacaggaggtggaaggaatgaggaaagagctcattctcatgaagaagcaccatgagcaggaaatggagaagcatcatgtgccaagtgacttcaatgtcaatgtgaaggtggatacaggtcccagggaagatctgattaaggtcctggaggatatgagacaagaatatgagcttataataaagaagaagcatcgagacttggacacttggtataaagaacagtctgcagccatgtcccaggaggcagccagtccagccactgtgcagagcagacaaggtgacatccacgaactgaagcgcacattccaggccctggagattgacctgcagacacagtacagcacgaaatctgctttggaaaacatgttatccgagacccagtctcggtactcctgcaagctccaggacatgcaagagatcatctcccactatgaggaggaactgacgcagctacgccatgaactggagcggcagaacaatgaataccaagtgctgctgggcatcaaaacccacctggagaaggaaatcaccacgtaccgacggctcctggagggagagagtgaagggacacgggaagaatcaaagtcgagcatgaaagtgtctgcaactccaaagatcaaggccataacccaggagaccatcaacggaagattagttctttgtcaagtgaatgaaatccaaaagcacgcatgagaccaatgaaagtttccgcctgttgtaaaatctattttcccccaaggaaagtccttgcacagacaccagtgagtgagttctaaaagatacccttggaattatcagactcagaaacttttattttttttttctgtaacagtctcaccagacttctcataatgctcttaatatattgcacttttctaatcaaagtgcgagtttatgagggtaaagctctactttcctactgcagccttcagattctcatcattttgcatctattttgtagccaataaaactccgcactagc

SEQ ID NO: 3218 - DNA, 2345 bp, Homo sapiens
agtcaccggcccctgctcaagaatgccagtgtgtgtgtagcctccacagagaggtcgttttctcggagtccagaggggccgcctgagcttctgagaactagggaggagccatcccagccatgagcccctgctccggagggagaggtgagctcagggcagcctgcctgcagccagaggtgccgggagccccgggcctgtcatggtggccatctacagccggcctgaggcagtcacagacggatttgcagctgagcctgtctatctggtgtgggaagaagatggggagttacttgtcagtcccggcttacttcacctccagagacctgtttcggtgttcagaatgccaggattccctcaccaactggtactatgagaaggatgggaagctctactgccccaaggactactgggggaagtttggggagttctgtcatgggtgctccctgctgatgacagggccttttatggtggctggggagttcaagtaccacccagagtgctttgcctgtatgagctgcaaggtgatcattgaggatggggatgcatatgcactggtgcagcatgccaccctctactgtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagaggtcaaccggatgcacatcagtcccaacaatcgaaacgccatccaccctggggaccgcatcctggagatcaatgggacccccgtccgcacacttcgagtggaggaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctcctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgt

SEQ ID NO: 3219 - DNA, 600 bp, Homo sapiens
gggacaccggggcgggggcaccgggaggaagctgccttggaagagtggactgacgccgcaggggcgagctagccggctccgcgcctctccgcgggatccagacgcctcctggggctgctggcggagggtctgaggcggcgcggccatggctcacctccggggatttgccaaccagcactctcgagtggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcagtcagtgcgacagcccctacatcacccgctactttggctcctacctaaagagcaccaagctatggatcatcatggagtacctgggcggcggctcagcactggacttgcttaaaccaggtcccctggaggagacatacattgccacgatcctgcgggagattctgaagggcctggattatctgcactccgaacgcaagatccaccgagacatcaaagctgccaacgtgctactctcggagcaggg

SEQ ID NO: 3220 - DNA, 1953 bp, Homo sapiens
gattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaagggtgctcgacggcacctctcggccctccaggtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactga

SEQ ID NO: 3221 - DNA, 559 bp, Homo sapiens
cagaaccagactcatccaggattaggaagctggggcccggcgtggacggcaggctcggggccaggatagcagcatcaaggagcattgtgtacatgcagaagtgcacagtacctggagtgaaactgcttgtgttcgatttctgataccattcataactggctgtgtgatctcaaaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtgacaagtggcagtctggattgtcaataaataatgttttcaaaatgagtagtgtacagaagatgatgcaagctggcaaaaaattca

SEQ ID NO: 3222 - DNA, 470 bp, Homo sapiens
gggcggtgccggggcggcggaggacggcttcaggcccaaaggggattgggcggcggctctaggtggcgggtcttggtttgcggaaggggctggagtcgctgcttctcggtgaccggcgcgtggcccggccaatcctgccgccgccacccacccgcaaccgcgtccgttgacggtcgggtccttggtcgccgggtccttgcgggcaccacagagcggggtggcgtccgctccctcgagtcctcggtgccagggaattcaccgctcaccaccccctgccccgccttgggtcctgctcggggaccaaaccactggaaggcagtggcgggaaacgggcgcctgtgccggagataatcctgatgtaaaccattgacatagccagaaaatcaccaggctgtgattttccaaactcagcttcataacctattctgtagttgagggaacatgagccatttgcagagcttattgttaga

SEQ ID NO: 3223 - DNA, 561 bp, Homo sapiens
agaagtcgagggtcatttgttcaaaagttggagaaatatcctcttttgttgcttcttctactctgtagtggagaatggggaactggtagttgtgtgggagttatgtgtctctaagatttgtcgacccattttgatggcaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaa

SEQ ID NO: 3224 - DNA, 4216 bp, Homo sapiens
gcaggggcgccggcgggcggatcgagaggaaggtcggggccatgggccggcactgcgcctcgggagggtccggccaccgctggaacccgaggccggggctgggggcgctccgggctccgacccacgggccggccggccctgcccgggctgggtgaggggcgcccgcctcaagctagaggaggagcggaggccgcgcgcggcccgccgagcgccttcaggatgctcatcaaggaataccacattctgctgcccatgagcctggacgagtaccaggtggcccagctctacatgatccagaaaaagagccgggaggagtctagtggtgagggcagcggcgtggagatcctggccaaccggccctacacggatgggcccgggggcagcgggcaatacacacacaaggtgtaccacgtgggctcccacatcccaggctggttccgggcactgctgcccaaggctgccctgcaggtagaagaggaatcctggaatgcctacccctacacccgaacccggtacacctgccctttcgtggagaaattctccattgaaattgagacctattacctgcctgatggggggcagcagccaaacgtcttcaacctgagcggggccgagaggagacagcgcatcctggacaccatcgacatcgtgcgggatgcagtggccccaggcgagtacaaagcagaagaggacccccggctttatcactcggtcaagacgggccgagggccactgtctgatgactgggcacggacggcggcacagacggggccccttatgtgtgcctataagctgtgcaaggttgagttccgctactggggcatgcaagccaagatcgagcagttcatccatgatgtaggtctgcgtcgggtgatgctgcgggcccaccgccaggcctggtgctggcaggatgagtggacagagctgagcatggctgacatccgggcactggaagaggagactgctcgcatgctggcccagcgcatggccaagtgcaacacaggcagtgaggggtccgaggcccagccccccgggaaaccgagcaccgaggcccggtctgcggccagcaacactggcacccccgatgggcctgaggcccccccaggcccagatgcctcccccgatgccagctttgggaagcagtggtcctcatcctcccgttcctcctactcatcccaacatggaggggctgtgtctccccagagcttgtctgagtggcgcatgcagaacattgcccgagactctgagaacagctccgaggaagagttctttgatgcccacgaaggcttctcggacagtgaggaggtcttccccaaggagatgaccaagtggaactccaatgacttcattgatgcctttgcctccccagtggaggcagagggaacgccagagcctggagccgaggcagctaaaggcattgaggatggggcccaagcacccagggactcagagggcctggatggagccggggagctgggggctgaggcatgcgcagtccacgccctcttccttatcctgcacagcggcaacatcctggactcaggccctggagacgccaactccaagcaggcggatgtgcagacgctgagctccgccttcgaggccgtcacccgcatccacttccctgaggccttgggccacgtggcgctgcgactggtgccctgtccacccatctgcgccgccgcctatgcccttgtctccaacctgagcccttacagccacgatggggacagcctgtctcgctcccaagaccacattccactggctgccctgccactgctggccacctcatcctcccgctaccagggcgccgtggccaccgtcattgcccgcaccaaccaggcctactcagccttcctgcgctcacctgagggtgccggcttctgtgggcaggtcgcactgattggagatggtgttggtggcatcctgggctttgatgcactctgccacagtgctaacgcgggcaccgggagtcggggcagcagccgccgtgggagcatgaacaatgagctgctctctccggagtttggcccagtgcgggaccccctggcagatggtgtggaaggcctgggtcggggcagcccagaaccctcggccttgcctccccagcgcatccccagcgacatggccagtcctgagcccgagggctctcagaacagccttcaggcagcccccgcaaccacctcctcctgggagccccggcgggcaagcacggccttctgcccacccgctgccagttccgaggcacctgacggccccagcagcactgcccgccttgacttcaaggtctctggcttcttcctcttcggctccccactgggcctggtgctggctctgcgcaaaactgtgatgcccgccctggaggcccagatgcgcccagcctgtgaacagatctacaacctcttccacgcggctgacccctgcgcctcacgcctcgagcccctgctggccccgaagttccaggccatcgccccactgaccgtgccccgctaccagaagttccccctgggagatggctcatccctgctgctggccgacactctgcagacgcactccagcctctttctggaggagctggagatgctggtgccctcaacacccacctctactagcggtgccttctggaagggcagtgagttggccactgaccccccggcccagccagccgcccccagcaccaccagtgaggtggttaagatcctggagcgctggtgggggaccaagcggatcgactactcgctgtactgccccgaggcgctcaccgcctttcccaccgtcacgctgccccacctcttccacgccagctactgggagtccgccgacgtggtggcgttcatcctgcgccaggtgatcgagaaggagcggccacagctggcggaatgcgaggagccgtccatctacagcccggccttccccagggagaagtggcagcgaaaacgcacgcaggtcaagatccggaacgtcacttccaaccaccgggcgagcgacacggtggtgtgcgagggccgcccccaggtgctaagcgggcgcttcatgtacgggcccctggacgtcgtcacgctcactggagagaaggtggatgtctacatcatgacgcagccgctgtcgggcaagtggatccactttggcaccgaagtcaccaatagctcgggccgcctcaccttcccagttcccccagaacgcgcgctgggcattggtgtctaccccgtgcgcatggtggtcaggggcgaccacacctatgccgaatgctgcctgactgtggtggcccgcggcacggaggctgtggtcttcagcatcgacggctccttcaccgccagcgtctccatcatgggcagcgaccccaaggtgcgagctggcgccgtggacgtggtcaggcactggcaggactccggctacctgatcgtgtatgtcacaggccggccggatatgcagaagcaccgcgtggtggcatggctgtcgcagcacaacttcccccacggcgtcgtctccttctgcgacggcctcacccacgacccactacgccagaaggcaatgtttctgcagagcctggtgcaggaggtagaactgaacatcgtggccggttatgggtctcccaaagatgtggctgtatacgcggcgctggggctgtccccgagccagacctacatcgtgggccgtgccgtgcggaagctacaggcgcagtgccagttcctgtcagacggctatgtggcccacctgggccagctggaagcgggctcgcactcgcatgcctcctcgggacccccgagagctgccttgggcaagagcagctatggtgtggctgcccccgtggacttcctgcgcaaacagagccagctgcttcgctcgaggggccccagccaggcggagcgtgagggcccgggaacaccacccaccaccctggcacggggcaaagcacggagcatcagcctgaagctggacagcgaggagtgaggcccacaccagcctggacctgggttatttattgacacacccaaggggcccgaggggctgcgtgtgggaggctggggacccagacttttggccccagcgctggcccccccagccccacaccctatatctccgtgtgctcctcggtgttacttccctttcatatgaggggacccagcgccggggggagggaggagggcgtgggcatgggcgcagaggcttttccagtgtgtataaatccatgaaaataaacgccacctgcacccca

SEQ ID NO: 3225 - DNA, 1969 bp, Homo sapiens
caagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccgagtttcactcttgttgcccaggctggagtgcaatggcacgatctcggctcaccgcaacctctgcctcttgggttcaagcgattctcctgcctcagcctctcgagtagctgggattacaggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagactggagtacctgcaaggcgcatgatgaaaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaa

SEQ ID NO: 3226 - DNA, 2684 bp, Homo sapiens
gaggaggaggcgagccgcagcgccgcggcgacgaacccagggagaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacgccagcttctgttactgatgtaaggatgcagagtcctgtcaggagttaggtgtcaagtgaagtctccttgttatggggcagtgcagctgtaggccaagctgtatctgtttgggaagggagaaaaaacagtagctggcatccatatccacttctccgggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 3227 - DNA, 2872 bp, Homo sapiens
agcagcgcaggtgagcgccgcttccggggtcgggcgcctggatagctgccggctccggcttccacttggtcggttgcgcgggagactatggcgtcctcctcggtcccaccagccacggtatcggcggcgacagcaggccccggcccaggtttcggcttcgcctccaagaccaagaagaagcatttcgtgcagcagaaggtgaaggtgttccgggcggccgacccgctggtgggtgtgttcctgtggggcgtagcccactcgatcaatgagctcagccaggtgcctcccccggtgatgctgctgccagatgactttaaggccagctccaagatcaaggtcaacaatcaccttttccacagggaaaatctgcccagtcatttcaagttcaaggagtattgtccccaggtcttcaggaacctccgtgatcgatttggcattgatgaccaagattacttggtgtcccttacccgaaacccccccagcgaaagtgaaggcagtgatggtcgcttccttatctcctacgatcggactctggtcatcaaagaagtatccagtgaggacattgctgacatgcatagcaacctctccaactatcaccagtacattgtgaagtgccatggcaacacgcttctgccccagttcctggggatgtaccgagtcagtgtggacaacgaagacagctacatgcttgtgatgcgcaatatgtttagccaccgtcttcctgtgcacaggaagtatgacctcaagggttccctagtgtcccgggaaccagcgataaggaaaaggttaaagaattgcccacccttaaggatatggactttctcaacaagaaccagaaagtatatattggtgaagaggagaagaaaatatttctggagaagctgaagagagatgtggagtttctagtgcagctgaagatcatggactacagccttctgctaggcatccacgacatcattcggggctctgaaccagaggaggaagcgcccgtgcgggaggatgagtcagaggtggatggggactgcagcctgactggacctcctgctcttgtgggctcctatggcacctccccagagggtatcggaggctacatccattcccatcggcccctgggcccaggagagtttgagtccttcattgatgtctatgccatccggagtgctgaaggagccccccagaaggaggtctacttcatgggcctcattgatatccttacacagtatgatgctaagaagaaagcagctcatgcagccaaaactgtcaagcatggggctggggcagagatctctactgtccatccggagcagtatgctaagcgattcctggattttattaccaacatctttgcctaagagactgcctggttctctctgatgttcaaggagctaggggaagggggttgtttgccttcttcaggacctgactggacagatggacctggctcaagcaactactctggatgcactttgctgtgtgggatgaactaaaagtgtctgaattttgctgataactttataaaactcactatggcatgcttccctcctggtgggccctaggatggatgacactcaagatactacagatgtgggtgcaggcatgcacacacacgatggaatatggccattcctacacaggtggggtagagagtgggtcagcagcctggcacctcacagaggtgggacctaagaggactcatgattatgcagagaattggattgggtctctgtcatagattgagtaatctcttcccttacctcaattccatctccacccatctctacatctgggcacagcaacccagagatggccaaaagcattcaagcctgggggaagatgtttgactattgctgctcttcaccagaacctcacacctctcctgggactggaacccttcagtgggtgtgtggccagttttggaggctggaatgatgggccagggtgtaggattcattctccatgtaaagtttcctttcatcctgcctagccatccccaaggtttatttccagaagaaaggaatatctctacttggatcaattctggtcatttcaagaggatggaggcctcaagtgtgggaacttcccctactccctggatgtgtgtacctagcacacttccttctcccacccctttttccagttggatttgtttttctgttctcttctgtcctgtcttatactgcaactgtgtctcctaggggacagatggccttctttgtcatcttcactctccacccccagagaggagtcagagccataactcaatcactcagcccctccaaagatagttgatgtgtgataatctcataatgttgagaaccctgatgagatacattgtcttcctctccctacaatgcctctggggccaaggcacccattcttcttgctatcctccatcccccttgaggcttccactttttttttttttagacataaagctgggcatcagcaactggcctgtggtgatgcaaagctgctttgctctgtatctggctggactgatctgtctcacaagaagccatgaggccatagggagaagctccctctccccttcatcttctgctccaaaggtggtagcaagaggagtacccagttaggggttggagcccccatataacatcttcctgtcagaagactgatggatctttttcattccaaccatctccctttcccccgatgaatgcaataaaactctgtgacaccagcaaccattgctctttagaaatgggttttctgatcatatggctgatgtgttatgggcagtatggatgtcttcatttgttgcttctgtttttcatcttttttgttttattaataaaaatttatgtatttgctcctgttactataataatacagggaataaattattcaatcc

SEQ ID NO: 3228 - DNA, 874 bp, Homo sapiens
ctcagcagccgggccaagaaaggtctttgggggcgcaagtctttggagggcaggtctttggggagcgctttgagtaatattagagctttcactaaaccctggcctattacgtcccctcccctgagatttacctttatatactcaagttctttcatgccaggaaggtaggctgaaggcttcgaaaacctgcagctcatacccaaagctagcactgtctatccctggagacccagcgcccaaaagctccactgggcgcatagcgcacggcacgcctcctcccccgagccgcagactgagtaactggccccggactaacctgaccagaagcaagagataaagtaataatgggtactgtggggaaaaacacagaagaacaattcggtaatatagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagaga

SEQ ID NO: 3229 - DNA, 489 bp, Homo sapiens
ccccgctcccgacctggcttacgcggtcccgaccccgcccagctccgtggcctcacctctgactcctaggccctccctgcctaatcccctgccgcgggagcccgtctcgaccccttccatgcctcccagtcccaccctgcccagggcaagcccgctcggtgtgacggttccccgcgagtcgagggtggagaagccagcctccttcccccgagtgggactctagcagcccacctcttttaggggtgctgagaacacccattactcatccacagctactagggtagctttctcagggtgcagtgcttacggggcggagggggatggaaacagacccatgccctggctggaagggagctccagtcgctagctctcagggccagagcggggcaggaggatgctttcccagccccaccatggagctgcgctgtgggggattgctgttcagttctcgctttgattcagggaatctagcccacgtggagaaggtgg

SEQ ID NO: 3230 - DNA, 2970 bp, Homo sapiens
aactacaaaattgaaagtagagaggagggggcagccaatggaaaaaaaaatttgcacagcagccaatcctcctgcggcgttttgtgcctttgcccaacaggaaaatgtgtctcatgcagaggggcgttacccagtctccaatgggcgggagccggtggaacggaggagccaatgagtgcgagatgttgagtgacagctgtccaatggaggccctccgtgctagtacggcttgcggcttaagcgccgccgcggtctgcggaatgtcaactattcaacatggaggcggaggtcgataagctggaactgatggtgagtgcaaagtgaaggagatctactgggtagtttatttttcccccatggcctcggaggtggggcacaatttggagtcgccggaaactccgggcggcggaggctggaccagagtcgagttccctcctcctgcaccaaagggagccgccaccgtctggtgtctaaaccgcctcggttccagaaagctgagtctgatctggattacattcaatacaggctggaatatgaaatcaagactaatcatcctgattcagcaagtgagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaacatttgtgttatacatgatatataatttcattttgtaaatgttgattgcacatgtggtcacattattgttgagactgcttttatgtgacctgtagtctcccacagaacctaaagtaataagctggcttttctgtgatagccacgtttgcgtatttctttccctatttcccttgcctgctaatgttgaacagcatgaacttgctttctgatgctgttttagactgtccctgttgtatctcaataatatctttgttttccttcagcctttattactataattgttcattctacatgaaagctaggaaactgaaattagaagagcacttatctgctacttgccagttttgcgtgagtgtgttatatgtatgtgtcaatttccctttaaaataactatttattttaaaataactattggcaataaggaaactgttcaaagtagaggcagatcttgatagaaagatgttaatcacagggttgtttataatagcaatatacatacacatttggctagtactaggtgaataggaaaataaatcatgctgtatgtatacaataagaggtcaagttgccaataaattattactgttaatgttctgggaaatgctgaaactatgctaagtgggggagagggaaagcaggtattgcagttttgtagtgaagattgggctttggagtcatatctgagatgtaagtagcagcttttaaattctagctatgaccctgtgcagatcacttaacttttgagtgtcaggatgtttggaaggacaagacaggaaagtgttttaatacagggttcagtatttagtaagccttcaataagtgatattacatacatgtaataaaaactaagcattgaaaggactaggaaaaatgcatcaaatgttagttctgcaggttatagaattatacttttatgtaattttaaaatttcagttatgaacatgtttgtccattaacaaacttataatagctgaaaaacagggttgtgagaacagcttcagttaaaattgtcctgtctagtttgaatatttcaagaacagaaagcctttttttttttttttttttttttgagacggagtctcactctgttgcccaggctggaatgcagtggtacgctctcagctcactgcaacctccacctcccaggttcaagcagttctctgccccaccctcccgagtagctgggattacaggcgcccgccaccacgcccggctatttttttgtatttttagtagagatggggcttcaccatcttgaccaggctggtctttaactcctgatggtgatccacccacctcggcctcccaaagtgctgggattacaggcatgagctaccgtgcctggcccccttttttttaattacagagaaataagttacaccttagtatcagatattaattttcttcagtgttcaggcaattagtatttagaaagctcttgtcatgagatggctctgggatgtgatgatgattgttgggattgaaaaaacggtagtatcatggagagatcataataaattcttagtattaaaagtggttttgctttcagttagggagaaaaattagattgtactatttttcctctatgatttccttcagttatcttccaaatgttgttttttccccacagcccccttaacattgttctctatgcacttctcaatacattttcatttgtttctcaagcctctttgtggatgactcctaaatataacttcttccactagctctagatccgtatttccaataaaatcccctacctgaatattcaagttaaacatgtccagaatacttactgattttattgttaatagccactattctgttgtctggaattaaaacctgtataactaatttgcatccctttatcttcttagtcaataaaacctacaatcctctttctaaaatggt

SEQ ID NO: 3231 - DNA, 3250 bp, Homo sapiens; identical to SEQ ID NO: 3151

SEQ ID NO: 3232 - DNA, 1306 bp, Homo sapiens
gagcgaagcgcacgctgaggaggatcggcggccggtgagggggaagcaagtctggtctctgtgattgaagaagtcggctctgggctccagtgcgggaatcacacacatacctcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggatatattgatttgtcaaaaagaagattaactttgtgggaaacagagtccaatttaaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatatttaactataggcttcttccttcttgtcaccagttaaaagcattttaatactaagaccctaattcttttatctttattttagtcttgatgtggaactgtaggagcaggtgaataaaggatctctataacagatcctttcaaaagaagagttttagagaaaataaatttaactttaaccacagtgaaagttgacccttagcgggacaaagccttaaaatgcattgaaagaattagatcggttctgtgccttttatctatttgagattgatgacaacctgtgtgagagaatttatcacaccacgtccttattggaataataagctacttgccttgagtttataattcagggtggtaaagtatgtttttaaattttaaaaagcagctgcattttttatttagttggaatatcacccaattttttatttttattgctattaaaatatccactagatgccacctagagctccagttctttataacaaaacagggatctgtttgaacact

SEQ ID NO: 3233 - DNA, 4599 bp, Homo sapiens; identical to SEQ ID NO: 516

SEQ ID NO: 3234 - DNA, 3484 bp, Homo sapiens
attgcaaagccacagggaacataccaggtgttacctccaaacacaggctctctttatattgacaaggattgttcagctgtgtactgccatgagtcaagcagtaatatatactatccttttcaaaagcgtgagcagctgcgagctggcaggtacatcatgaggcatacttcagaggttatctgtgaggttctggatcctgagggaaacacttttcaggtcatggctgatggtagcatatcaactatattacctgaaaaaaaattggaagatgatttaaatgagaaaactgagggctatgatagtctgtcctctatgcaccttgaaaagaatcatcagcaaatctatggtgaacatgtccccaggttttttgttatgtatgctgatggatcaggaatggaacttcttcgagacagtgacatagaagaatatctatctttggcatataaagaatcaaatactgttgttctccaagagccagtgcaggaacagccaggcaccctaaccatcacagtccttcgccctttccatgaagcatcaccatggcaagtaaaaaaggaagatacaattgtccctcctaatctccggtcaaggtcatgggaaacatttccctcagttgagaaaaaaactccaggacctccgtttggtactcagatttggaaaggcctttgcattgagtccaaacagctagtgagtgccccgggtgccatactcaagagccccagtgtgctacagatgcgccaattcattcagcatgaggtcataaagaatgaggtgaaactgaggctgcaggtttcccttaaggattacataaactatattctaaagaaagaagatgagctgcaggaaatgatggttaaagattccagaactgaggaggagagaggcaatgctgctgatctcctcaagctggttatgtctttccctaaaatggaggaaactacaaaaagtcatgttactgaagttgcagctcacctaactgatttattcaagcagtctttggctacgcctccaaaatgcccaccagacacatttggtaaagatttctttgaaaagacatggagacacacagcatcctcaaaacgctggaaagaaaagatagacaaaacgaggaaggaaattgagacaacacagaattacctaatggatattaagaaccgcataataccacccttttttaaatctgaattgaaccagttatatcagtctcagtataatcacctggacagtctttccaaaaaactgccttcttttacaaagaaaaatgaagatgcaaacgaaacagctgttcaagatacatctgatcttaatctagatttcaagccacataaggtttcagaacagaaatcctcaagtgtgcctagtcttccaaaaccagagatttctgcagataagaaggatttcactgctcagaaccaaactgaaaatttaacaaaatctcctgaagaagcagaatcttatgagcccgtgaaaattccaacccagtccttgctgcaggatgttgcgggacaaacaagaaaagaaaaagtgaagttgcctcattatttgctgagttccaagcctaagtctcaacctcttgcaaaggtgcaagattctgttggaggaaaagtgaacacatcctctgttgcatctgctgccattaataatgcaaagtcatccctttttgggttccatcttctcccatcatcagtcaagtttggagtgcttaaggaaggacatacctatgccacagttgtaaagctcaagaatgttggagtggacttctgcaggtttaaagtaaagcagcccccacccagcacaggactgaaagtgacttacaaacctggacctgtggcagctggtatgcagacagaactgaatatagagttatttgccacagctgttggagaggatggggccaagggatcagcacacatctctcacaatatcgagattatgacagagcatgaggttctgttcctacctgtggaagcaaatatcctttaaagttcaacttgagtaatcatatatagtgcagaaattacacgagtgaggaaaacatggaagtcaaaatgcatctctactttattaattctatcttcaaaatcagagttaaatttattaagacaaagagcatcttcattcatctttgaaagcacctagccaaatctaaaaaaatacctgacacatagtatatgtgcagtaacttcagattgaataaatgtaaatgttattggctatctacggaatatcagacagaataataaaacagcaagtatctatcacaaaaaaattataattttatggaaggataggaaataccttattattataaaggttgggtattcactgaattatgcatgcattcctccttatcagtgtcttcagccaaacagatattagatagatatcaagaacctattacctccaaggtactgtataaaatagtttatcatatataaaaatggataattggactctgtcttaaaaggtattatataatttgtagcagaaataaagtcttcacattttatttctattttgtactttctccagtggcatgaattgtgtgctgcttgtgttacagttctctatttatttgatttttgagctggatcttatagaatgtgaaaacttgattgacgggaactttaagtaaaaataatgaacaaaaccatggcaacaggaaagctccaggtgtttgggatgattggcagggagttcaacttgccaaaagcttgagtattaggaatatagtgggaaagtaggttggagtcaagttatgaaagatcttaaatccttggcttgaattttattatttaagcagcagtgaaccactgcagattcctgaccctgtgggtgacatgatcagcatatctttattaagatgaatccagggttattgtgcaggacatgtcaaaggggaacaactggatgtgtaaaagtaccattagaagtctacctgaatgggccatgtgtgaggacaagaactgggagtgggggaacagtcaacataaaagagggacatgaatgaaagacatggtgggggaaggaaactgcaaaatctgaggtagaagccattgatggatggaagaaagaggacatcgagttcaacttcaaagttttgggctgaggtaatgaatcatgtatatgtaatattagatctcaactgagaagtcagaattggagatataataattttaagcatcgtttacacagaggtgatggctgaatgtatgggcaaggaacagaaatctggagtcggtttagggagcaggaggaagaagagccagtggagacaaaagcagcaattagaaaatggtgaaatacttcaaaagccttaggaagaatttcaaggaaaagacggacacaattgacggatgctattgagatgtcaaagaaaattcagatttaaagtgttaaatttggttgggataaaaactaaattgcaaaaggtaaagaatgactgtattaagaaagcagaaacattagttatggatattctttc

SEQ ID NO: 3235 - DNA, 3381 bp, Homo sapiens
agctttcaaaaatagcatagttgatgaaactggaaatttaggtgcgggctcttttaagaaatcatttgtcttcagtcttaagaatagactgacaacagatactgctaccagagggctctcaactatttcttaagaccccctaggaaatatcagaagaaaagcctccttctcaataaagcataagtaggacatctcgttttcagtgaatcagacacttggattggacttaatcttaaacctctggagttcaagaccttttaaaaagggctaaataaacaatctctacatgtaaaaggccactgactcctacttcctctgtatagagcaactgttgaactcagctgcctgtagggcgtgattctcagtcaccagactcagcaaaaggttttagaagcgttcgaccaaacctacaagataaaagatcaccaactcaggcaccccctccaccagaaagaaaagagagctttcatagctctttgataaccagtcacacaaagggtgtcattttagaccagttagtaactaacacacaaattccctccagtacagagtactttgctaacaaaaaacctcttcagggaactatgtattccaatgaagattcgagacagacaattgtatattctgaagaatctaacacaaccatgtcatatacacaaaaaatcactaatccactaccagcagcttccagcacggatcctgcaccattcgctaacatcaacaccccagttctacaagaggactacaggcaagattctcaaactcggaggatttctaccttgaaactaacccataaccaggatctaggaagtagcagccccattagtactccacagttctccaaatctgtcgaagtaccgtcatttctcaaaaggccccgctcactgacccctaatccagtgcctgagacacacacagcatctctttccattcagatagctcccctttcaggacaggatcttgaaagccacaaacagctacctgagctttctccagagactgcaaagatacctcttcagcaagagagacaaaaatctgcagttgcagcggcctctcagtcctcagactgcagagtgagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccggcctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaa

SEQ ID NO: 3236 - DNA, 225 bp, Homo sapiens
atgagatactatggcagctactacagaggcctgggatatggctgtggaggctttggtggtctgggctatggctgtggctgtggaggctacagatatggctctggctatggaggctatagatatggctgctgccgcccatcatgccgtgaaggatatggattctctggattcaaaaaacttgctgattctcatactctaactccaagatcttgcccgtatgcttca

SEQ ID NO: 3237 - DNA, 563 bp, Homo sapiens
ctttgttgtgagctgcggcagagactggtggctggaggagacgccggcgctggagagtgcgctgcgccgcccgccgctgagggaccgcggggttagccactgctggctgcttccagtgttcgccgagaggtaccgggggtgacagctccgggaccggccgaaaggcgaggaaccggtgtggaaattaaaagaacacacatattttgactggggctttgatcaaccaaatgctaaaaaggctggagtgcaatggtgcgatctcggctcactgcaacctccgcctcccgggttcaagtgattctcctgtctcctgggttcaaccacataaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtga

SEQ ID NO: 3238 - DNA, 1083 bp, Homo sapiens
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagacggagtctcgctcttttgccaggctggagtgcagtggcgcgatcctgagtcactgcaacctccacctcccaggttcaagcgattctcctgcttcagcctgccaagtagctgggactacagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgagtctttccctctgaaacaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaag

SEQ ID NO: 3239 - DNA, 2865 bp, Homo sapiens
agtgccccccgcgccccgctccggcagctccacgctcgcgcccgccatgccggagcagttcagcgtcgccgagttcctggccgtcaccgcggaggacctcagctccccggctggggccgccgccttcgccgccaagatgccccggtaccgaggggcggcgctggcgcgggaggagatcttggaaggagaccaagccatcctgcagagaataaagaaggctgtgcgggcaatccatagctccggccttggccatgtggagaatgaagagcagtaccgagaggccgtggaatccttaggcaacagccacctgtcccagaacagccatgagctgtccacaggcttcctaaacttggccgtgttcacccgcgaggttgctgcgctcttcaagaacctgattcagaacttgaacaacattgtctctttccccctggacagtctgatgaaggggcagctgagggacggtcgacaggcttctctttccttggggtctagggccaagctggagaaggagcgcgatcgggccagggtgacaggagggatccctggggaggtggcccaggacatgcagagagagcggcgcatcttccagctgcacatgtgtgagtatctgctcaaagccggggagagccagatgaagcaaggtcctgacttccttcagagcctcatcaagttcttccacgcccagcacaactttttccaagatggctggaaggctgcccagagcctgttccccttcatcgagaagctggcggcctcagtacatgcactccatcaggcccaggaggacgagctacagaagctgacccagctccgggactccctccgagggacactgcagcttgagagcagagaggaacacctgagccggaagaactcaggatgtggctatagcatccaccagcaccaaggcaacaagcagtttgggacggagaaagtgggctttctatacaagaaaagtgacggaattcgaagagtctggcagaaaaggaagtgtggagtcaagtatggctgcctgaccatctcacacagcacgataaaccggcccccggtgaagctgaccctgctgacgtgccaagtgaggccaaaccctgaggagaaaaagtgcttcgacctggtgacccacaaccggacgtaccactttcaggcagaggacgagcacgagtgtgaggcgtgggtgtcagtgttgcagaacagcaaggacgaagccctgagcagcgccttcctcggggagcccagcgctggcccggggtcctgggggtccgccggccatgatggggagccgcacgacctcacaaagctgctcatcgcggaggtgaagagcaggcctgggaatagccagtgctgcgactgcggggctgcagaccccacgtggctcagcaccaacctgggcgtgctcacctgcatccagtgctcgggcgtccaccgcgaactgggcgtgcgcttttcgcgcatgcagtcactcaccttggacctgctgggcccctccgagttgttgctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctg

SEQ ID NO: 3240 - DNA, 1220 bp, Homo sapiens
cagtgtttatagcatagtccactgggactgccgctctgacaaagactgtgtcactactttgtggaatgttattttagaacttccagaatgcctcagtaaatcctgactgccatgtaactgtgtactgtgctgctgagctcttaacatgaagcagcagcagtgaccctggcgggccaggctgacgtgcgtgggaacagtgggagtgaccctggctgggaagcagggaggcctggatattgtttctcctggctctgtgtcctgccattctcatccctgtgctcagagctctcaagcacccacgatggccttctcaggccgagcgcgcccctgcattatcccagagaacgaagaaatcccccgagcagcccttaacactgtccacgaggccaatgggaccgaggacgagagggctgtttccaaactgcagcgcaggcacagtgacgtgaaagtctacaaggagttctgtgacttttatgcgaaattcaacatggccaacgccctggccagcgccacttgcgagcgctgcaagggcggctttgcgcccgctgagacgatcgtgaacagtaatggggagctgtaccatgagcagtgtttcgtgtgcgctcagtgcttccagcagttcccagaaggactcttctatgaggaacgaacgtgatggttaagctaccttcattaagcagcatgaccgcttcctgagctcctgctgccgcatttaggccctgtcagctgtgaggccactggtgctgagtcagagggaaaagctcagaacagccttgagcagcgaagaataaagcatgactcatctcgtcctgcccacccctcacactggactataaataccctccctgggtctgtgtgctgttattccaaaagatgcgatgaatacccagaactaggctattcatgggctgttgcccagttcaagctctattgggtcctgaggaagattactattttggctacattgtttatcattaaaaccagcccagggatgtgtaaacctgcatctggagaataagacatttctttttggttaaatgatattagagaaaaaaaaaactatccaaggctgctaacaaataatcttcactttcaattatatccagcaataagttgttctccagaaaagaaagcttggaaacttacccagtttgccttccatttgggacatgactgatgtgcttcagtctttgtataataaatgcatcttcgccactcta

SEQ ID NO: 3241 - DNA, 2007 bp, Homo sapiens
gtgatttggcgggagtcttgaccgccgccgggctcttggtacctcagcgcgagcgccaggcgtccggccgccgtggctatgttcgtgtccgatttccgcaaagagttctacgaggtggtccagagccagagggtccttctcttcgtggcctcggacgtggatgctctgtgtgcgtgcaagatccttcaggccttgttccagtgtgaccacgtgcaatatacgctggttccagtttctgggtggcaagaacttgaaactgcatttcttgagcataaagaacagtttcattattttattctcataaactgtggagctaatgtagacctattggatattcttcaacctgatgaagacactatattctttgtgtgtgacacccataggccagtcaatgtcgtcaatgtatacaacgatacccagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggagatagtggagcaaaccatgcggaggaggcagcggcgagagtgggaggcccggagtggctctgggagtgaacctgtggccgctgcattggagaagagctccaggttgttcgccggtcccatgagtgacaggacagccccaaggtctcccagaagagacatcctctttgactacgagcagtatgaatatcatgggacatcgtcagccatggtgatgtttgagctggcttggatgctgtccaaggacctgaatgacatgctgtggtgggccatcgttggactaacagaccagtgggtgcaagacaagatcactcaaatgaaatacgtgactgatgttggtgtcctgcagcgccacgtttcccgccacaaccaccggaacgaggatgaggagaacacactctccgtggactgcacacggatctcctttgagtatgacctccgcctggtgctctaccagcactggtccctccatgacagcctgtgcaacaccagctataccgcagccaggttcaagctgtggtctgtgcatggacagaagcggctccaggagttccttgcagacatgggtcttcccctgaagcaggtgaagcagaagttccaggccatggacatctccttgaaggagaatttgcgggaaatgattgaagagtctgcaaataaatttgggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggagtaacctggacaagctgtaccatggcctggaactcgccaagaagcagctgcgagccacccagcagaccattgccagctgcctttgcaccaacctcgtcatctcccaggggcctttcctgtactgctctctcatggagggcactccagatgtcatgctgttctctaggccggcatccctaagcctgctcagcaaacacctgctcaagtcctttgtgtgttcgacaaagaaccggcgctgcaaactgctgcccctggtgatggctgcccccctgagcatggagcatggcacagtgaccgtggtgggcatccccccagagaccgacagctcggacaggaagaacttttttgggagggcgtttgagaaggcagcggaaagcaccagctcccggatgctgcacaaccattttgacctctcagtaattgagctgaaagctgaggatcggagcaagtttctggacgcacttatttccctcctgtcctaggaatttgattcttccagaatgaccttcttatttatgtaactggctttcatttagattgtaagttatggacatgatttgagatgtagaagccattttttattaaataaaatgcttattttaggctccgtcccc

SEQ ID NO: 3242 - DNA, 4426 bp, Homo sapiens
atgccatcggaaaagaaaattagcagtgcaaatgactgcatcagcttcatgcaagctggctgtgagttgaagaaagtccggccaaattctcgcatttacaaccgttttttcactctggacacagaccttcaagctcttcgctgggaaccttcaaagaaagacctcgagaaagccaagcttgatatttctgccataaaagagatcagactggggaaaaacacggaaacatttagaaacaatggccttgctgaccagatctgtgaggactgtgccttttccatactccacggggaaaactatgagtctctggacctagttgccaattcagcagatgtggcaaacatctgggtgtctgggttacggtacctggtttctcgaagtaagcagcctcttgattttatggagggcaaccagaacacaccacggttcatgtggttgaaaacagtgtttgaagcagcagatgttgatgggaatgggattatgttggaagacacctctgtagagttaataaaacaactcaaccctactctgaaggaagccaagatcaggttaaagtttaaagaaatccagaagagcaaggaaaaactaaccacccgcgtgaccgaagaggaattttgtgaagctttttgtgaactttgcaccaggccagaagtgtatttcttacttgtacagatatctaaaaacaaagaatatttggatgccaatgatctcatgctctttttagaagctgagcaaggagtcacccatatcaccgaggatatatgcttagacatcataaggagatacgaactttctgaagagggacgtcaaaaagggtttcttgcaattgatggctttacccagtatttattgtcatcagaatgtgacatttttgatcctgagcaaaagaaggttgcccaagatatgacccagccattatctcactactatatcaatgcctctcataacacctatctaatagaagaccagttcagggggccagctgacatcaatgggtacattagagctttgaaaatgggctgtcgaagcgttgaactcgatgtaagtgatggttcagataatgaaccaatcctttgtaatcgaaataacatgacaacccatgtttcctttcgaagtgtcatagaggtaataaataaatttgcctttgttgcttctgaatacccactcattctttgcttgggaaatcactgctccttgccgcagcagaaggtaatggctcaacagatgaaaaaggtctttggcaataaactctatactgaagcacctttgccctcagaatcctacctcccatcaccagaaaaattaaaaagaatgatcattgtgaaaggaaagaagttgccttctgatccagatgtgttagaaggagaagtaacagatgaagatgaagaagctgaaatgtctcgaaggatgtcggtagattacaatggtgagcagaagcaaatccgactctgtagggagctctctgatttggtgtctatttgtaaatctgttcaatacagggattttgaactatctatgaaaagccaaaactattgggaaatgtgttcatttagtgaaacagaggccagccgcattgcaaatgagtacccagaggattttgttaattataataagaagttcttatcaagaatctatccaagtgccatgaggatcgattccagtaacttgaatccacaggacttttggaattgtggctgtcagattgtagcaatgaattttcagactccgggtccaatgatggaccttcacacgggctggtttcttcaaaacgggggatgtggttatgttctaaggccgtctataatgcgagatgaagtttcttacttcagcgcaaatacaaagggcattctacctggggtgtctcctctagctcttcatatcaagatcatcagtggtcagaatttcccaaagcccaagggagcttgtgccaaaggggatgtcatagatccctatgtttgtatagagatacacggaattccagcggattgttcggaacaaagaactaaaactgtacagcaaaacagtgataatcctatttttgatgaaacttttgagttccaagtaaacctacctgagctggccatgatccgttttgttgttctggatgatgactacattggggatgagtttatagggcaatatacgataccatttgaatgtttgcagcctggatatcggcatgttcccctgcgttcttttgtgggtgacatcatggagcacgtaaccctttttgtccacatagcaataactaatcgaagtggaggaggaaaggcacagaagcgcagtctttcagtgagaatggggaagaaagttcgggaatataccatgctcaggaatatcggtcttaaaaccattgatgacatctttaaaatagcggttcatccattacgagaagccatagatatgagagaaaatatgcagaatgcaatcgtgtctattaaggaactatgtggactccctccaattgccagtctgaagcagtgcctgttaactctgtcatctcggctcatcaccagtgacaatactccttcagtctcacttgtgatgaaagacagctttccttacctggagcctctgggtgcaattccagatgtgcagaaaaagatgctgactgcttatgatctgatgattcaagagagccggtttctcatagaaatggcggacacagtccaggaaaagattgtacagtgtcagaaagcagggatggagttccatgaagaacttcataatttgggggcaaaagaaggcttgaagggaagaaaactcaacaaagcaactgagagctttgcttggaacattacagtattgaagggccaaggagatctgttgaagaatgccaagaatgaagctatagaaaacatgaagcagatccagctggcatgcctgtcctgtggactgagtaaagcccccagcagcagtgctgaggccaagagcaagcgcagcctggaagccatagaggagaaggaaagtagtgaggagaatgggaagctgtgactctgggcattatcgacacgttcacccatcttatcaaggactctggtttctcattcttgttttctttctttaaatgttttataagttcacaaaatggtgccctatatggggtattggacatagatattttcacaatgtcagtatttcagtgtagttaatttatctaaattaaagcctttagtatcagtgttttaaattctgagacatgtgtcaacacccctgtgtggatgcctgtggaagagtgtgtgtgtgtgtgtgtgtgtgtgtgtgtggcagagagagagaaagagagagagagagagaaattctgttaaaatctattctgtgttgcattattcatttagtgagttattccttgatcattttgggacaattgttttaatctgaaattctaaagagcacttactgtaacctgttgctgtgtttaatttgacttctctgcctttgacatttaatttagtgatcttagcatagcttattattgaaggaagccaaatttatcaaagcatagatgttttggtagattaaatatagattagaaaaattcctaagaatcagagtagaaataaaagtgaatgaaagattaaacagatgatgagaatttctaaaaagattagcaaggtcatttcttcagtcagaaaactttaaaaaatatttattaaataaaatcaatttttaggaagttttctgtagtcatttactaaacatatgatttcactagaaaagctgatcataagtgaatttatacctacctgtgtggtactctgaaacacactgaaagctctgttgcaattaggattttgatgtgacaataatattgttgtataatttcgagatttgtaggaaggtctcattcttccaagctgagagtctagcactcattttctataacagatatggcagcttagaggtgttggctttgtttggatgtaatttagggtactaaatttaaatttaaagatattgttcaaacaatatcatatcatcacattgagctgatataaattctgtgggtccgataatatctttgtgataatttaagagctaaccagttaccacacatctatgatataaccctaacacacacagaaaagcatacatgcaaaaagaaatgactaattagggtacatttataattgcatctaggtaatttttaccctaatgtcttcataaagtacttgagtgtaatgtttgttacctccaacagaactaaatgttctatggttatgaaagaatatatttatttaaagcattgcttttattttgaaaagcttcttaattaatttgattaacaaatatgctaatttggggaaacctagagaagataattgttgaaattttgcaaatataaacatctcctatagcttctgtgttatttctgacttcttaacactattatgtttatgttgcacattactgaaagagtaaagat

SEQ ID NO: 3243 - DNA, 787 bp, Homo sapiens
aattagctggcatggtggtgcacgcctgtggtcccagctacccgggaagctgaagtgggaagatctattgagcctgggaggttgaggctacagtgagctgtgactgcgcttgaacctgtgcctgcgcttgaacctgtgcctgaatactaccctagacagtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttg

SEQ ID NO: 3244 - DNA, 556 bp, Homo sapiens
atcgtcttaaggaggtatttggtggaggctctttgaagttgggttcaggagtgtagaattggcaaagttattgccagcttcctgggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaa

SEQ ID NO: 3245 - DNA, 1736 bp, Homo sapiens
agacacgccgggctctcggggcaccacagccatgtgctcgttagcgtcaggcgctaccggttattcacatctgctgaagaaacattttcacactgtaagtctgagcatcagtttaatattgacagcatggttcataaacatgaatcctacagttgagtacatgaattccatatacaacccagtgccttgggagaaagaagagtatttgaagccagtattagaagatgaccttttacttcaatttgatgtagaagatctttatgaaccggtgtcagtacccttctcataccccaatggactcagtgaaaatacatctgttgttgaaaaattgaaacatatggaagccagggcactgtctgctgaagccgcattggccagagcacgtgaggatctgcaaaaaatgaaacaatttgctcaggattttgtgatgcacacagatgtcagaacctgctcgtcatctactagtgtcattgcggacctccaggaggatgaggatggtgtttatttcagctcatacgggcattatgggatacatgaagaaatgctaaaggacaaaatacgaacagaaagctaccgagatttcatataccaaaatccacatatcttcaaagacaaggtagttttggatgttgggtgtggaactggaattctctctatgtttgctgctaaagctggggcgaagaaggttcttggagttgatcaatctgaaatactttaccaggcaatggatattataagactaaataaacttgaagatactattacactaattaaaggaaagattgaagaagttcatcttcctgtagaaaaagtagatgttatcatatctgagtggatgggctattttcttctgtttgagtctatgttagattctgtcctttatgcaaagaacaaatacttggcaaaaggaggctcggtctaccctgacatttgcactatcagccttgtagcagtgagtgatgtgaataaacatgctgatagaattgctttttgggatgatgtctatggcttcaagatgtcctgcatgaagaaagcagttattccagaagctgttgtggaagttttagatccgaagactcttatttcagaaccttgtggtattaagcatatagattgccatacgacgtctatctcagatttggaattttcatcagattttaccctgaaaatcacaaggacatccatgtgcacggcaattgctggctactttgatatatattttgagaagaattgccacaacagggtcgtgttctctacgggccctcagagcaccaaaacacactggaaacaaacagtatttctactggaaaaaccattttcagttaaagcaggtgaagccttgaaaggaaaggtcacagttcacaagagtaagaaagatccacgttctctcaccgtgaccctcacgttgaataattcaactcaaacttatggtctccagtgaaacagccataaaagcacactaccttgtagtttttaatgtgggggtagagtgggtcagcaggagggagctggttttatgtgagcagatggatggatgatggaccctttcctaatgagcctcctcaataagagagaagttctcattgtgggaatctgacatagttcagctgaggaagagaatcagctgatcctcatggtctgccacgtaatcattttcttagacgtttgctccaccagatttaaccaaatgtaactcccacattgagtttatctatattgaaaatcatttacattgg

SEQ ID NO: 3246 - DNA, 747 bp, Homo sapiens
gtgcgcttgtcacgcgtggcggtgcgtggttgctaggggcgcctgaggctgccgggtagcccagcaggccgagggaggaagtagcgtggagccggtgccgagccggggcgaagctggatcccctagactgacagacttcaaggatgcagctgctactaccggaggtgtgtggcaccttacctcagcaaggccatgagaccgtgtggccatgatgtgggcccctcatggcctcagcaggaacacagcactatagtattggcctccgccagaaaaacagcttcaagcagagtggtccctcaggcacagtacctgccacgccacctgagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcagttcctgttacctacactctctcccggacttgttcaacagcaccctgctataccgccgctccagctataggcaaaaaccgtaccagcaactggagtctttctgcttgcgttcgagcccgtcagaaaaaagccctttttctctccctcaaaagagcctccctgtcagtctcactgccaacaaggccacttcttccatggtcttctccatggcccagcccatgg

SEQ ID NO: 3247 - DNA, 3691 bp, Homo sapiens
atgcagaaggaaagagagctccaggagaccatatatttcaagaacacgtggcctgcttgtatgttcttaatagttgctcctctttctgtcctctacaactggaaggatgaattggacacctggggatatttcagagtcactgttttacatggaaacagaaaagataatgaattaattcgtgtaaagcagaggaaatgtgaaattgctctaacaacttatgaaacactacgcttatgcctggatgaacttaacagtttggaatggtcagctgtcattgtggatgaagctcatagaatcaagaatccaaaagctagagtaacagaagttatgaaagctttgaaatgtaatgtccgcattggcctcactggaaccatccttcagaacaacatgaaggaactgtggtgtgttatggactgggctgtgccaggccttttagggagtgggacctacttcaagaagcagttttctgacccagtagaacatggtcagagacacacggcaacaaagagagaactagccactggccgaaaggccatgcaaagacttgccaaaaagatgtctggctggtttctcaggcgcaccaagactcttatcaaggatcagttgcctaagaaggaagaccggatggtgtattgttctttgacagatttccagaaagctgtctatcaaacagtgttagaaacagaggacgtgactttgatacttcaatcttctgagccttgtacctgtaggagtggccaaaaaaggagaaattgttgttataagaccaattctcatggtgaaacagtgaaaaccttgtatctcagttaccttacagtccttcagaaggtagctaaccatgtcgcgctactgcaagctgctagtacttccaaacaacaggaaacacttatcaaaaggatatgtgatcaggtattttccagattcccagattttgtgcagaaaagcaaagatgcagcctttgaaacactttctgaccctaaatacagtggaaaaatgaaggtccttcagcagcttttaaatcattgcaggaaaaacagagataaagttcttctcttttctttttccaccaagttgcttgacgtgctacagcagtactgtatggcgtctgggcttgattaccgacgacttgatggaagtacaaaatcagaggaaagactcaagattgtaaaagagttcaacagtacacaagatgttaacatttgccttgtctctacaatggctggtggactaggcctcaattttgtcggtgccaatgttgttgtattatttgatcctacttggaatccagccaatgatcttcaagccattgacagagcatataggattggacaatgtagagatgtcaaagtgcttaggctgatatccttgggaactgtggaggaaatcatgtatttacgacagatatacaagcagcaacttcactgtgtggtggttggaagtgaaaatgccaaacgatattttgaagcagttcaaggatctaaagagcatcaaggagagctttttgggatccataacctcttcaaatttaggtcccaagggtcttgtcttacgaaggacatcctggaggtgtgaacttcttctctgaccttttcaataatattttaaatacagtttttcttcctcaggaaatctgaaatacaattgctgttgccttttcagagaaacttttggttttctttatcaaaaatgccttggaatttttacttttagagaataagaaatgaattattgtacctctaaactaagattttcccatgcataattacaaataatgcacacacacaaatgtatatgctgggtagtatgaactccaaggcaattttaaataggcagagagaagtttatagttttgaaaacagctgctgaagtcaggaactaaaaaaagaggttttcctaaataaacaaaaatataaaatgtgttttaattaaaagttaccaaatactccctgagatgtactctcatgtctcatggagatttttgttttctgttcccaataaaaattccacaccagtattttaaactctccctgttgtgttcatcctcagcatacagatgtttcttattcctcaaacaaaatattttatatccttttttaaaaaaatctttaagttcttttatataccggaatactaaggatattaacctattttctaattgatattcatataggtatcataaaatcctggagtatcatctttttcaacctcctcatggtatagatgaggaaactgagtcttagagaacttcaggatatttctcttgacttccaggactttgtagtaaaatcttaatgtacttcatttattcagtaagtaccataaaggcagttcaaggagcaattggttcctgtccttgaggaacttaaaccatcttgaccggaggtggaagagaacgtttacataataaccatgcaatgtcaggaatcgtatgctgaacaagttaaacagtagaccatggatggctgggggagaggaaggtatatattatttgaatcctataaatgttgttactattatacagtttctgatatatactgctgagtttctattttatagtaactatatttgattctgaattcagtggcccatttggagtcctactttttggggttttttccccttgctttttaaatacgctgtttctttcatgaatttgttctttccagtttcccttttcatatcaataactttgtttgccctccagctcccaaacccagctgctacctccatctcagagtactacttgacatgcctatattgatgttaaagtcaattgtctataaaaatattagcattttattatttatcctgttttctgtcatatatgacatagttacctgtttttatcagaataaccacctatttctttgttaaacaagtgttatataagacatatcaggatgacaggttattaagtagaaaaagttcccttgtttatcgtgccactgcactccagcctggggaacaaagcaagagacttgtctcaaaaacaaaaaacaaaaacaaaaaaaagttctcttgttcactggttattctaagaatatcttgtttcaccttcagaagtgtttattaatgacaggaccatccatgtcttacattttcttttttaaaaatatcttttaagttctttaatataccagaacactaagaatattaacctattttctaattgatattaataaggggtgacaaggccatccatgccctacatttgtcttgctaggcatatcattggcacttgattattaagttaaattttgaattaaaattactcatttgtcatcaatcagaatgtaaatttattcaggattggttagattcatgctgctttgggccaaaaggtgcttctaaatattattattagccccatataatgggagtacctatcataaagtaaaaggagtatttcacttcatgtgagacatttttaatttttaaaggttgtataaaatctcttttaaaatgttttaagatgtaaaaatttgaatatttacacttataatcttatgatttctgggcaatttcattctgttttgcattgactttccattatctatattatggtttctcttcaaagatagatattgagagttcattttacaagtatttgttgagcatctgctaaatgtcaggtactgttcatagagctttgcatacataaaagaacaaaataaacaaaacgatcctgtct

SEQ ID NO: 3248 - DNA, 2870 bp, Homo sapiens
gtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaacagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagatttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatatctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtg

SEQ ID NO: 3249 - DNA, 3139 bp, Homo sapiens
gtcggtgcctgcagggctctccgtggccgctcgggagaggtgctcttcgctcaggctcccccggagacttgagggggtgcgcgctggcgtgcatggggcctgttctgtccttggtttggggatgctcctaaggggggagaaagggatacctcgggtgcttggaggtcgagagacggatacgtaagtgcgcaagggccactgattagggcacgggaagggctcgctagaatgagctcttaaactggttgggtgtaagcggttttgggctagtctaaaccaaacaactgagaataaacgcggggttcctgcaggttgagagagtacctgtctgcaaatgtccagtagtgatggattgccttgtaggccccagagcaatcggggaagttagcattcttgttcaagaagctgctggttcacttagagctataaaagaatgttgtgagtttggattttcttccaaacgttcaggattgaggttagggctggtggtgagggatcatgtaaagaggtttgagtggctcagccttaggtcccggtgtggaaagcttattcttttggtgtcatcacgtggccgtgggaattatttagaatgtgatctgccctcatgagaagaaaggagctctgaagccgttgcagttcttcctccctatgtggaaaatcgaatttctggaaacatcctccgtattgggagattttgcctatgtaaaggctatccttattggctagcggcactaattactttaaaagtaggatggaagtacaagtatctcaagcatcattgggtttcgagctcacttctgtggaaaagagtttaagggagtggtctagactttccagggaagttattgcctggctgtgtccctctagtcctaattttatacttaactttcccccacctccttcagcctcatctgtttcaatggtgcaactcttttcatccccttttggttaccagtcaccttcaggccattcagaggaggaaagagaggggaatatgaagtcagccaagccccaagtgaaccacagtcagcatggggaaagccagcgggccttgagccccctgcagtctactctgagttctgctgcatctccttcccaagcgtatgagacctatattgaaaatggactcatatgccttaaacacaaaattagaaacatcgagaaaaagaagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgagtgttgaagaccagatggagcagtcatccttgtacttttgggaccttttggaaggtagtgagaaagcagtggtaggaacgacatacaaacacttgaaggatctactgtctaaattgctgaactcaggctattttgaaagtatcccagttcccaaaaatgccaaggaaaaggaagtaccactggaggaagaaatgctaatacaatcagagaaaaaaacacaattatcgaagactgaatctgtcaaagagtcagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgcctaagcctgtgcatcagcctgtaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactgcccctggcaaccaccattctactttctga

SEQ ID NO: 3250 - DNA, 682 bp, Homo sapiens; identical to SEQ ID NO: 2784

SEQ ID NO: 3251 - DNA, 1103 bp, Homo sapiens
attcacaagtgtgtgtaaagggggtgtggatgggacaactgcatctgcctcttgtgcatgccttggggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaag

SEQ ID NO: 3252 - DNA, 1356 bp, Homo sapiens
atggcggagggcgcccagccgcatcagccgcctcagctcgggcccggcgccgccgcccggggcatgaagcgggagtcggagctggagctgccggtgcccggagcgggaggagacggagccgatcccggcctgagcaagcggccgcgcactgaggaggcggcggccgacggtggcggcgggatgcagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgcagacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcagtctccctttagttcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactga

SEQ ID NO: 3253 - DNA, 859 bp, Homo sapiens
gccgcgggatgttctcccgaaggagccacggggatgtgaagaagtccacccagaaggtgctggacccgaagaaggacgtgctgacccgcctgaagcacctgcgggcgctgctggataatgtggatgcaaatgatcttaagcagttttttgagaccaactattctcagatatatttcatcttctatgaaaattttatagcactggaaaatagtttgaaattaaaagggaataataagtcacaaagggaggagctggactccatcctcttcctttttgaaaaaatactgcagtttctacctgaacgaattttctttcgatggcattaccagagtataggctcaactttaaagaagcttctacacactggaaattctattaagataagatgtgaaggaatcaggctgtttcttctgtggcttcaagcacttcagacaaactgtgcagaagagcaggttctgatttttgcttgcctggtgcctggtttcccagcagtcatgtcatccaggggcccttgcacactggagacactcatcaatcccagccctagtgtagctgatgtaaagatatatccagaagaaatcactccactcctaccagccatatcaggggagaagattgctgaggaccaaacctgcttttttcttcaaatactgttgaagtatatggttattcaggctgcgagcttggagtggaagaataaggagaatcaagatactggttttaaatttctttttacattgtttcgaaagtattatcttcctcatttatttccatcatttactaagttaacaaacatctacaaacctgtacttgacatcccccatttgagaccaaagcctgtgtacattactaccactcg

SEQ ID NO: 3254 - DNA, 1150 bp, Homo sapiens
aagcgcaggcggccaatggaacccgggagcggtcgctgctgctgaggcggcagtgtcggcagtccaaccgcgactgcccgcaccccctccgcgggggtcccccagagagttgagtccacgctccatgagaatgctgaacaccatccaaagcagcaaattgagattccttgatttggggaagaggtttgggaggaacccttcaataattggcatgggacaagaggggacccagtccaagtgtatttgggactcgcagtagggaggaacaattcagagagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggatgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgc

SEQ ID NO: 3255 - DNA, 906 bp, Homo sapiens
attttgggttcgctttgcgaggggaaacgatcccagtgtcggttgcgggatccgcctcctctcagtttgcccctttagccctccacctttcccttctcctctctcgcatttccgccagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgtttgttagctttaggactgaagcattttgaagggactgagtttcttaaccctct

SEQ ID NO: 3256 - DNA, 3250 bp, Homo sapiens; identical to SEQ ID NO: 2921

SEQ ID NO: 3257 - DNA, 1085 bp, Homo sapiens
gttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacgacagaggtgacagttctacactaacaaagcaagaacttaaattcataggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaa

SEQ ID NO: 3258 - DNA, 560 bp, Homo sapiens
atattagataatggagaagcaaatggcaaggatggttaccttggctaccaagataaagaaccttgaaaagggaagaagatgaaatcagcttcggatatcaggcaggcagctgggtctgtgggtcagaggcttaaggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtggga

SEQ ID NO: 3259 - DNA, 683 bp, Homo sapiens
ggcagctggcagcactgaaagaaattcaggctgaagttcaggaaaaagaaagtgatgctgtgaagccaaagaatcaggacattcaaggagggaaagcagcccctgctgaagctctgggaatcccggatgagcactatctagataatttgtgtattttttgtggggaaaggagtgaatccttcacagaggaaggtctggatctccactactggaagcactgtctcatgctgacaagatgtgaccactgcaaacaggtggtcgagatatccagtctgacggagcacttgctgacggaatgtgacaaaaaagacgggtttggaaagtgttaccgttgcagtgaggctgttttcaaggaagagctgcccagacacataaaacacaaggattgcaaccctgccaaaccggagaagctggcaaaccggtgtcccctgtgtcatgagaacttcagccctggagaagaggcatggaaagctcacctgatgggcccagccggctgcacgatgaacctgcgcaagacacacattctgcagaaggccccggcactgcagccaggtgagggacagcgccgctgagcaggtgtagtctgcatccctccattttgacttattcaaaaaagcatccccgtccagggcaacatggcaagaccccatccctttaaaagcaaaataaagcatccaagcctg

SEQ ID NO: 3260 - DNA, 1008 bp, Homo sapiens
aactccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattataattgca

SEQ ID NO: 3261 - DNA, 2065 bp, Homo sapiens
cagctcggtgctgattatcacaactgtttggtgacctacttcactgacctgtgaggattccttcccttcaggtactggattcttgatctttctgcatcatcaagaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgcctagaactcactgaagcagggctcaaggtggtaggctatgcttttgaccaggtagatgatcatttacagactccctaccatgaaacagtctactccttgttggatacactcagccccgcctaccgagaagcatttggaaacgcactgcttcaaagactggaagctttgaaaagagatggacagtcatgactacactttttcctttcagaggggctggtgctggtacagaatgttgatataaagcttaaaattcttgcatatggtcatagaaaatgcatctttggttttgtgtttttatcacttgcttccaacttaggcttttggctcagaagattattgaataatgatttgtcttagtttctgtttcagtaagggaattctgaggccgttgctatgataccatcattaagacattcacatgtcttcatataatatctcttcatttcaaatcctaatcactatttcatactattacagggctttgatgctgccagcactgtcttttacataggaaattctagatttgcacagtaatagaggaattagaagtacctaactatacactttgattcagcctgctaaatcaggggttcaatactagcttggacaaactttgtagtaattaattgctaccagccttattggaaacaaattatcaactagtttcccctgcacaaattttgaaattcactgcttcacttaatctatttatattactaataatggattaataaagatgaattaattatatattacttaactagtattaaatgaaaaacagggactgaaatagttctgtattccgtgtttgcaacagccagccaactaagcagaggataaaccgttagcaaatgaatgtaataattactcatttccaagatatctaagcacataagcaaatacaggaacagacttcattctttttcttaacaaaaaagcatcttcagtgtgtgatttaaaagaaagaagattctggtttcctagaaaacaatattttggcctgtgttgattcttattctgaatgtgtgtttacataatgtacagtatatattcagaaagtatttttgcttcaacgtttactttctatgatgtagtgctttggtattcctacagcaccccaccttccccaacagatgtacagtgttctgtctccattcgaaatctacaatgtaatatgagtgcattgtatgggtttgaaaccaaaggatgaatgaagcattcagagacttaatatttgaaaaaggaatagtcagtattttatattttattacaggtactgatatttataaatttaataaactgtaccatgctgctgcatgttttcaagtacatgttgaacagtaaggattggggagttgttttttaatggtcacctaaagcagctgctatagaaatgttgaactaaaattttgcatctggtcataccttcatgcatttatcatttgcagatatttttccatcattattaaaaaacaggaacttttaggctctgaagatcatgtggaccagagcaaattaaagttcagtttgtgtcacaattcattgccagacttcattggaatgctttgtttgatgatgtatgttcattctcagctttattttcagatgcttaactgggcaacgaagtctaacttcaggttgaactttctcatgtttaatctcaggctaaatgtaaatgatatttgtaaagtttgaataaaattctgtttactcattttgagttagtatg

SEQ ID NO: 3262 - DNA, 1179 bp, Homo sapiens
attttggtctcaggtgtggactcggcaagaaccagcgcaagagggaagcagagttatagctaccccggccgcggagccggctcactgcactacccccgcccccttctttcctccagacgccgaagtcgcgggcgctcatggcgggcctggaggtactgttcgcatcggcagcgccggccatcacctgcaggcaggacgcgctcgtctgcttcttgcattgggaagtggtgacacacggttacttcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtaggtaagcaagctactgtagctcttctgaggtatctgccaggctgttttctgtagcctcagattgcctatctgcttagcctgagaacaggtagatgaaaactaaactgatgcctaggcccagggtcagtctcagatggaagctgggcctgggtggggaggctagcatgcgtggctccctgggtatttctgtcagtccccatggcaagcagtgatttagtaaaacaccccagagtcagggaagccaaccaccttgaaacctttaga

SEQ ID NO: 3263 - DNA, 1124 bp, Homo sapiens; identical to SEQ ID NO: 2733

SEQ ID NO: 3264 - DNA, 4599 bp, Homo sapiens
actttgccagagcggccgggtccccattcccattccttcaaatcccctttttcccggcagccgacctgtagacccaagggagacaggttgaagctagaaagagtcggggcagcagctctggtaggggagggagcatccaaaacctctggcttctgagcgcctctcctgccgcccatccacaaagccccccacagcctggcggctgccctcgaccccgcaaaacaaaggacttcagaggctggacctacagacccagatgagaaggcaaaagcgtagggaggagcggcaggagatgggaagggcgggccccgctcggagcagctgccgcttcctcccaaagtcccacgaggggcctgagtcacgggccaccgccctgggtcggcgagctgggggaagggatctggacacctggcgtgtccgggcgggaagctggtgagggcccctggggacagagcggaggaccagtggttggggcgagaagagggcagtcccgcagcgagtcccacgcggggtgggagggatctaggccccgccctctcctcggctccgccctgcgcccccttccctctcctcattgtccttagacaaagcggtcgccgcccccgcccggccccctggtctctgtctccgtccctcctcctttgctgcctctttccctcctcctctccctccctcctcccctccctccagtctccggatctccctcggtccctctctcctcctcttcctctctctggacgcccggctcctccgcaccccctcccccgggggtcccgcggcctgtgagttgactgaggggctcagacttggggagtgggtgtctcctcgcccctgtccttgctcccgtccctggcccggaccttggctgtctcctctttgtgccgagattgtcagtctgtgcggctacagcggggtggagacggccggctctgtcacggcttcatgagagcggggacggggcgcaggacttgcaggcgccggggagaagagacatggagccggcccttggcactctggggtcgcgtggggcagtcggtgggggaggcaggcggtggtgacaggacagggtgggggtggacgccagggttctgggaacgcgctggcagccctgacgcccgggttccgaaagtctcgggggtgggtatttcccccgacccgcctcgggggcggagtgcggggcagaggggtgggggctggggagaggcgtggcccgagcggtgctggaagcggagccgggacctttggggcccgcgctgagacgcgcccggctgctgccgccgccctcctttcccctcttccctggtttcccttctcctctagacctgttcgctctccgcccctccttgcctccccaacaccccctcaggtcccgttgcctcctggtcctttcagggattcctggtccttccttcccacactagcctccctggggtatcgctgaggcagcctggcctgcacccaggttcccctcacccctgccacatttctctcttctccctcacgccaactttccttttcgcccttctctctctttctcacatcctagagacggtctttaatacgcattaaccctgtgctgccacatctggctcctgccctcattgcctccaatccggactcttcctctcacatcacccccaccacccccaacttgggctcacaacttctcttcactttttccatttccccagttctctgccttccgtctttccctctgtcctcatccttagcccctctgccctgctttgtgtcccacctctccccctccacttcctctcctcccaccctcagtctcacccccgggctgtctcactctctggagcctctccttcctgttctctgtccccagtgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccgggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctcctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 3265 - DNA, 3250 bp, Homo sapiens
gagtcaggaatggagagaagggtaatggtgttacctcttattgtggaaacctgttgagatcacagagaatatactgacggcataaaagggcagaaccatagcagggtgcgcgctgctgtagttgccttccatggatctataggagagcaagtcctccaggagaagaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccctagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttataagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 3266 - DNA, 2020 bp, Homo sapiens
aatggggacctggaacctgggcttactagagtgccgcgcgtagggctccaggtcgctggcttctgcgcttccttcctctccaaagttgagtatctcctatctgtgtcctcgtacatactgccgcctgaggtgccatggcccccaagccgggggccgagtggagcacagccctgtcccatctggtgctgggagtggtgtctctgcacgcagccgtgagcacagccgaggcaagtcgaggggctgctgctggcttcctgctccaggtcttggctgccaccaccacgctggccccagggctgagcacacacgaagactgccttgctggagcctgggtggccaccgtcatcggccttccccttctggccttcgatttccactggtgtactaatggtcacttgatgtgcgctggctgttttatccacctactagcagatgcccggctgaaggaggagcaggccacgtgccccaattgtcgttgtgagatcagtaagagcctctgctgccggaacctggccgtggagaaagccgtgagcgagctgccttcagagtgtggcttctgcctgcgccagtttccccgctccctcctggagaggcaccagaaagaggaatgccaggacagggtaacccagtgcaagtacaaacgcatcggctgcccatggcacggccccttccatgagctgacggtgcacgaggctgcgtgcgcccacccgaccaagacaggcagtgagctgatggagatcctggatgggatggaccagagccaccgcaaggagatgcagctgtacaacagcatcttcagcctgctcagcttcgagaagattggctacacagaggtccagttccggccgtaccgcacagacgacttcatcacgcgcctgtactatgagacgcccaggttcacagtgctgaaccagacgtgggtcctgaaggctcgagtcaacgactcggagcgtaaccccaacctgtcctgcaagcgtacgctctccttccagctcctcctcaagagcaaggtcacggcaccgctggagtgctccttcctgctgctcaagggcccctacgacgacgtgaggatcagccccgtcatctaccactttgtcttcaccaacgagagcaacgagacggactacgtgccactgcccatcattgactccgtggagtgcaacaagctgctggctgccaagaacatcaacctgcggctcttcctgttccagatacagaagtagggcggggcctcaggatgtccgaggagcccacgggcggcatcccagcaccgctgccctgtccacctggctggcagctgcttcacaggactatctgatcactttagcaaaggaggagaacaaacgaagccaacacagggcaagtctgcatgcgtgcgcgacggggcccccgcctccggctcacccccccgacccctgcctcccctccttccgagggccgccagaggctgggctgacccgaagaggagacggtgcaccaggcgccccgaggctcagagacggtggcagcaaggaggccgagaggcacagcgaccctgccccagcccttctgtgcagtcaggcggcggtgctgctccatccctgcgggttccggcggggcgcgggggccttgctgacatcagacgggatatccgaatatctgatagcaattaaaaggcagccttgtttcgtactttctgttttgttcgaggggaaggcatggctgtgaatggacagcgtgggggctttggtttggcctgggggtcagagcctgccccgcccccatctgtgtgcccgcacacgtcccccgaggaaagactcagagacactgcctccccctacactctgtcatggggtcttgagactgaggcttgggcaggaagatccaggtagggtcggggctgccctggccaaccggccgctcccagggagacaggactcagccaccagggctcagcaggcattttccgaaagcagggtgaaattgtctcttcccaggaaaaagattaaactccttgcaggctcttggataagttacacaa

SEQ ID NO: 3267 - DNA, 540 bp, Homo sapiens
tggctgccttctcctgagagtcggagccacagccagagccctgcccaggccgagccggagctgcagcccgagcgcggtggtgccctcagccccgtcctcttgtcctcctcagcctcgaaacttccaattgaagacactgagctgaaccattccgcccgcccgcccgcccgagggcactccagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccgg

SEQ ID NO: 3268 - DNA, 2926 bp, Homo sapiens
aggtgtcaccacagtgatggcagtggaggacagcacgctgcaagtagtggtacgggtgcggccccccacccctcgggagctggacagtcagcggcggccagtggttcaggtggtggacgagcgggtgctggtgtttaaccctgaggagcccgatggagggttccctggcctgaaatggggtggcacccatgatggccccaagaagaagggcaaagacctgacgtttgtctttgaccgggtctttggcgaggcggccacccaacaggacgtgttccagcacaccacgcacagcgtcctggacagcttcctccagggctacaactgctcagtgtttgcctacggggccaccggggctgggaagacacacaccatgctgggaagggagggggaccccggcatcatgtacctgaccaccgtggaactgtacaggcgcctggaggcccgccagcaggagaagcacttcgaggtgctcatcagctaccaggaggtgtataatgaacagatccatgacctcctggagcccaaggggccccttgccatccgcgaggaccccgacaagggggtggtggtgcaaggactttctttccaccagccagcctcagccgagcagctgctggagatactgaccagggggaaccgtaaccgcacgcagcaccccactgatgccaacgcgacttcctcccgctcccatgccatcttccagatctttgtgaagcagcaggaccgggttccaggactgacccaggctgtccaggtggccaagatgagcctgattgacctggctggctcagagcgggcatccagcacccatgcgaagggggagcggctgcgggagggggccaacatcaaccgctctctgctggcgctcatcaacgtcctcaatgccttggccgatgcaaagggccgcaagacccatgtgccctaccgggacagcaaactgacccgcctgctcaaagactccctcgggggcaactgccgcacagtgatgatcgctgccatcagcccctccagcctgacctacgaggacacgtacaacaccctcaaatatgccgaccgggccaaggagatcaggctctcgctgaagagcaatgtgaccagcctggactgtcacatcagccagtatgctaccatctgccaacagctccaggctgaggtagccgctctgaggaagaagctccaagtgtatgaggggggaggccagcccccaccacaggacctcccaggatctcccaagtcgggaccaccaccagaacaccttcccagctcccccttgccaccccaccctcccagccagccctgcaccccagagctccctgcagggcctagagcccttcaagaggagagtctggggatggaggcccaggtggagagggccatggaagggaactcttcagaccaggagcagtccccagaggatgaggatgaaggcccagctgaggaggttccaacccagatgccagagcagaaccccacacatgcactgccagagtcccctcgcctgaccctgcagcccaagccagtcgtgggccacttctcagcacgggaactggatggggaccgttctaagcagttggccctaaaggtgctgtgcgttgcccagcggcagtactccctgctccaagcagccaacctcctgacgcccgacatgatcacagagtttgagaccctacagcagctggtgcaagaggaaaaaattgagcctggggcagaggccttgaggacttcaggcctggccaggggggcacctctggctcaggagctgtgttcagagtcaatccctgtgccgtctcctctctgcccagagcctccaggatacactggccctgtgacccggactatggcgaggcgactgagtggccccctgcacaccctgggaatcccgcctggacccaactgcaccccagcccaggggtcccgatggcccatggagaagaagaggaggagaccaagcgccttggaggcagacagtcccatggccccaaagcggggcaccaagcgccagcgccagtccttcctgccctgcctaaggagagggtctctgcctgacacccaaccttcacaggggcccagcacccccaaaggagaaagggcctcctccccctgccattcccctcgcgtttgcccagccacagtcatcaaaagccgggtgcccctgggcccttccgccatgcagaactgctccaccccgctggctctgcccactcgagacctcaatgccacctttgatctctctgaggagcctccctcaaagcccagtttccatgaatgcattggctgggacaaaataccccaggagctgagcaggctggaccagcccttcatccccagggcacctgtgcccctgttcaccatgaagggccccaagccaacatcttccctccctgggacctctgcctgcaagaagaagcgcgttgcgagttcctcagtctcccatggccgcagccgcatcgcccgcctccccagcagcactttgaagaggccagctgggccccttgtactcccaggtgactggcactagggacagggatagcctgggccatggaggccgatgaagacaagaaggaggaggggacggggagctgagacccagaagaaaggagggcctagggtattgccaagcatctcagggatgctgctgatgagacaggtgggaggtgggctggaggacggggacagagcgtcactttccttcctcgctgcactccccgccacccatccaactggcctgcagagctgcccttgagtcccctgtgccctagcaaccggaggaatggaaaggacctcatcagggtggggagagcactctcagcagggaacggcgtcaccaaggtgtcctgaccgccagaatgtcctgaccaccaaggtgtcctaacctaccggcccctctgctggatacccctcttggacctgtagccacctgcaccag

SEQ ID NO: 3269 - DNA, 2853 bp, Homo sapiens
cctccctccagtctccggatctccctcggtccctctctcctcctcttcctctctctggacgcccggctcctccgcaccccctcccccgggggtcccgcggccttgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccgggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctcctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 3270 - DNA, 1270 bp, Homo sapiens
gactgctggaggcggccacagcgccatgttggatgctctgctcgttgagtgaagaaaatccaccggcatcgcctgagccccgctaccgagaagggcgccgcttcctccggggagggggataaagatcccccgccgccggcccatgaggatattgccgtgaaaggcacagcgactgcagcaggaaccggacccggcaccggagcggcggcggcggcggcagcagcggtaccgcctcctcacccggcggcggcagcagcggcggcggcggcggcggcggcggcggcggcggcagcggtcccccctcctcacccgaacatcagggccctccagactcaggcgccccaacaaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagc

SEQ ID NO: 3271 - DNA, 3473 bp, Homo sapiens
agcacttgaagttcaggcagcgagagttgacatggggccagggctgcgcccctggggcgggttgaagacagggtgagtctcttgatattcaggaaatcatcgcgcacccagtcaccagcgttcgggagcctgtcgcagcgggaccgacggaatccggagcaggcgacagggcgcagaagcgggatgtacttctgttggggcgccgactccagggagctgcagcgccggaggacggcgggcagccccggggctgagctactgcaggcggccagcggggagcgccactctctgctgctgctgaccaaccacagggtcctctcgtgcggagacaacagcaggggtcagctgggccgcaggggcgcgcagcgcggggagctgccagaaccaattcaggcattggaaaccctaattgttgatctcgtgagctgcgggaaggagcactccctggctgtgtgccacaaaggaagggtcttcgcatggggagctggttctgaagggcagctggggattggagaattcaaggaaataagtttcacacctaagaaaataatgactctgaatgatataaaaataatacaagtttcctgtggacactaccactccctggcattatcaaaagatagccaagtgttttcgtggggaaagaacagccatgggcagctgggcttggggaaggagttcccctcccaagccagcccgcagagggtgaggtccctggaggggatcccactggctcaggtggctgccggaggggctcacagctttgccctgtctctctgtgggacttcgtttggctggggaagtaacagtgccgggcagctggccctcagtgggcgtaatgtcccagtgcaaagcaacaagcctctctcagtcggtgcactgaagaatctaggtgtggtttatatcagctgtggtgatgcacacactgcggtgcttacccaggacgggaaagtgttcacatttggagacaatcgctctggacagctgggatacagccccactcctgagaagagaggtccacaacttgtggaaagaattgatggcctagtttcgcagatagattgtggaagacttcgtggatgttcaagtcaaacacatttttgctggaacatatgccaactttgtgacaactcatcagtgaaattagaatgatattttcatctcctgcttgtctgactgcaagttttttaaagaaaagaggaactggagaaacgacttccattgatgtggacttagaaatggcaagagataccttcaagaagttaacaaaaaaggaatggatttcttccatgataactacgtgtctcgaggatgatctgctcagagctcttccatgccattctccacaccaagaagctttatcagttttcctcctgctcccagaatgtcctgtgatgcatgattctaagaactggaagaacctggtggttccatttgcaaaggctgtgtgtgaaatgagtaaacaatctttgcaagtcctaataaacaaagctaactgtcgactaccagaaaatactttcaacataaatgaactctccaacttattaaacttttatatagatagaggaagacagctctttcgggataaccacctgatacctgcagaaacccccagtcctgttattttcagtgattttccatttatctttaattcgctatccaaaattaaattattgcaagctgattcacatataaagatgcagatgtcagaaaagaaagcatacatgcttatgcatgaaacaattctgcaaaaaaaggatgaatttcctccatcacccagatttatacttagagtcagacgaagtcgcctggttaaagatgctctgcgtcaattaagtcaagctgaagctactgacttctgcaaagtattagtggttgaatttattaatgaaatttgtcctgagtctggaggggttagttcagagttcttccactgtatgtttgaagagatgaccaagccagaatatggaatgttcatgtatcctgaaatgggttcctgcatgtggtttcctgccaagcctaaacctgagaagaaaagatatttcctctttggaatgctgtgtggactctccttattcaatttaaatgttgctaaccttcctttcccactggctctgtataaaaaacttctggaccaaaagccatcattggaagatttaaaagaactcagtcctcggttggggaagagtttgcaagaagttctagatgatgctgctgatgacattggagatgcgctctgcatacgcttttctatacactgggaccaaaatgatgttgacttaattccaaatgggatctccatacctgtggaccaaaccaacaagagagactatgtttctaagtatattgattacattttcaacgtctctgtaaaagcagtttatgaggaatttcagagaggattttatagagtctgtgagaaggagatacttagacatttctaccctgaagaactaatgacagcaatcattggaaatactgattatgactggaaacagtttgaacagaattcaaagtatgagcaaggataccaaaaatcacatcctactatacagttgttttggaaggctttccacaaactaaccttggatgaaaagaaaaaattcctctttttccttacaggacgtgataggctgcatgcaagaggcatacagaaaatggaaatagtatttcgctgtcctgaaactttcagtgaaagagatcacccaacatcaataacttgtcataatattctctccctccctaagtattctacaatggaaagaatggaggaagcacttcaagtagccatcaacaacaacagaggatttgtctcacccatgctcacacagtcataatcacctctgagagactcagggtgggctttctcacacttggatccttctgttcttccttacacctaaataatacaagagattaatgaatagtggttagaagtagttgagggagagattgggggaatggggagatgatgatgatggtcaaagggtgcaaaatctcacacaagactgaggcaggagaatagggtacagagatagggatctaaggatgacttggacacactccctggcactgaagagtctgaacactggcctgtgattggtccattccaggaccttcatttgcataaggtatcaaaccacatcagcctctgattggccatgggccagacctgcactctggccaatgattggttcattccaggacattcatttgcataaggagtcaaaccacaccagtcttggattggctgtgagccaattcacctcagtctctaattggctgtgagtcagtctttcatttacatagggtgtaaccatcaagaaacctctacagggtacttaagccccagaagattttgctaccagggctcttgagccacttgctctagcccactcccaccctgtggaatgtactttcacttttgctgcttcactgccttgtgctccaataaatccactccttcaccaccc

SEQ ID NO: 3272 - DNA, 2373 bp, Homo sapiens
acctgctgggagctggaggaggcgcggagcgaagccggccctgccagccacgcggagaagcagaggcaggtgagcgcgatgcagccggcgccgggtctggggctcggggactcctccctgcaccgctacctggacggcgacttctggagcctcaagaacgagctgcgcggactcctcggcggcgcccgctcttccggcaaaggtatgatttaagcttggatgaaatgagagctttgacagttcagagagtgaagtttgccatggacctgcctctgttaaaacgtgcaggtcaggatctggcagagaaaacaaagaattttgtcagccgaagccttgtcataggagaagtcctctccatggcggacatggccacaggagtgaagtgcggaataatttattggctatttggtggtgctatcaggaatctcggaagccctgaacatgttactaagtggtttcagccactccaggagcagaaatacactgggatgtttgcaatgaccgagaggggccatgggagcaacgcgagagggatccagaccgaagccacctttgacctctctgcccaggagtttgtaattgacacgccgtgtgaaaatgcggagaagatgtatattggaaatgccatgtacgggaattatgcagctgtctttgcccagctcatcatagatggaagatctcaagggccccactgtttcatcgttcctgtccgggatgaaaacggaagcttgtacccaggagtcacagctattgatatgatgtacaaggagggtctgcatggtgtggacaatgggatattaatatttgacaaggttcggatacccagggagaacctgctggataagtttggttccgtggctccagatggacagtaccattcgcctattaggaacaagagtgcaagattcaatgccatgctggcagcactgaccccttcgagattagctgtggctttccaagctatgggtgccatgaagcttgggttgacgatagccattcgctatagccacagccggaggcagtttgggcccaaaaccaaggaagaggtgaagatcattgagcaccaaacacagaccctgcggctgatgccccacctggccacagccttggccctgaccttcgtcagcaggtatgctggggccctcctggatgaggatgtcttccagggaaaggagctggtcaacagtcgctcgctgcaggctctggtggcggggctgaaggcctacagcacctgggagaacatccgctgcctgcaggactgccgcgagtgcactggaggcatggttgtggggcgggaactgctggcccaatacaccaaacagtatgaagaaaaaccactctttggcctgctccaaaactgggctgaatctgtgggggacaagctgagaaccagtttcctggcatttaacatggacacagttgatgatctcgcctttctgttgaaagcagtgaaatttcgtgaaagggttcttcagcggggtttggtggccagaatttattataaggtaaagaccaagaaggaggattttttccatgcctggaactcgtgtctgcaccacgtggcttctctgtccctggcacacactcaccgagttaccttagagcagttctccctagcagtgaagagctgtcctgaccaagaggaccagactttgttaatgaagttttgtctgttgtatggaaccaagctggtgtttcaggagcgggcctggtatttagaacataaatacttgactcccatggccagcacgaggatcaggaatcagttgctggatttgtgcgactcggtgaaggatgatgcccggagggtgatctcgacctttaacattccacacacctacctccacgcaccaatcgccggaatctccaacccgcgggccgcgtgggctttctaccctgcaccgctgcagccgcggccacgggaagaggcgcgctcccggcggcccaagctgggagccaagctctaacgggtgtggcgggaagtgtggtggcccgccagcagctgccacgacgctcgctccaccgacgcccagagctgtggccgaggccgggggctggcacccgctgggccgccactctcggggattttggtggcaaagcggaggtcccgccgaggctggcgaggtgcgcggctggctgctaggaaagagatccagacggtcgcctggtgcgctggatccctgtgccctttccctgaaacccagcctggcctgactgcaacctctcccaacttcagtgccggatcccctagacaatcagggtgggctccccgctgcgagcgcgccccacagccgggtgccgccaaaggtctcctgctgttagcggtgactcacattcccagtgatttagaaaaactgtggtgccgagtgaaag

SEQ ID NO: 3273 - DNA, 787 bp, Homo sapiens
cttgactggaagggtccccattccttctttccgatccgcgattaccctggactcgaagtcagcagacccggttctaggccagctctgcctctcaccctctgtgaccttgggcaaatcatacaactctgggactcagtttcttcctctctaaaacggagatgactgttgctccatcagtctcagccagcaagttcagctccggcaagtcatttgattcacccggtgatgaaatgggggtcaaccagtctgtgggctttccacctgtcacaggaccccacctcgtaggctgtggggatgtgatggagggtcagaatctccaggggagcttctttcgactcttctacccctgccaaaaggcagaggagaccatggagcagcccctgtggattccccgctatgagtactgcactggcctggccgagtacctgcagtttaataagcgctgcgggggcttgctgttcaacctggcggtgggatcttgtcgcctgcctgttagctggaatggcccctttaagacaaaggactctggataccccttgatcatcttctcccatggcctaggagccttcaggactttgtattcagccttctgcatggagctggcctcacgtggctttgtggttgctgtgccagagcacagatgtgtgtatttcagggaccggtcagcggcaaccacctatttctgcaagcaggccccagaagagaaccagcccaccaatgaatcgctgcaggaggaatggatccctttccgtcgagttgaggaaggggagaaggaatttcatgttcg

SEQ ID NO: 3274 - DNA, 3478 bp, Homo sapiens; identical to SEQ ID NO: 986

SEQ ID NO: 3275 - DNA, 3020 bp, Homo sapiens
atgggcccctcggggaggcgaggcctgcgggcgagcccttctgagggcagggggtgagggggcggcgcccgccagccaggacagcatcctgccgccgtgacaagcacgcctccggttgccaaaacaacccaaaaatgtgcctcaaaacacgttcgcaaagccccgggccggccggtcgcctgcctctcacctagcccgaccgcccgacgtcctactgccgagcgagggcgagcaagccaatgagtcgcaatcccagcagcaatagcccagaagaggacacggttcccgtaccgaagggttcagtaccagcagcccgaccatcacgcggcgggatgtctgtggttggcattgacctcggctttctcaactgctacattgctgtcgcgagaagtggcggcatcgagaccatcgccaatgagtacagcgacaggtgtaccccggcctgtatatcattgggatcaagaactcgagccattggaaatgcagcaaagagccagatagtcacgaacgtaagaaatacaattcatggcttcaaaaagcttcatgggcgatcatttgatgatcccattgtgcaaactgaaaggatcaggcttccctatgaactgcagaaaatgcctaatggaagtgcaggagttaaggtgcggtacttagaggaagagagaccttttgcaattgagcaagttactggaatgctgttagccaagcttaaagagacttcagaaaatgctttgaagaaaccagtggctgactgtgtgatttcaattcctagcttttttactgatgccgagagaagatctgtgatggctgcagcccaggttgcaggcttaaattgtttaaggttgatgaatgaaactactgcagttgcactggcgtatggaatttataaacaggatcttcccccattagatgagaaaccaagaaatgtagtatttattgatatgggacattctgcctatcaggtcttggtttgtgcttttaacaaaggaaaacttaaagtcttggctactacctttgatccatatttgggtggcaggaactttgatgaggctttagtagactacttctgtgatgagttcaagaccaaatataagataaatgtgaaagaaaactctcgggccttgttgcgtttatatcaggaatgtgaaaaactaaagaagctaatgagtgcaaatgcatcagatcttccattgaacattgagtgtttcatgaatgaccttgatgtttctagtaaaatgaacagggctcaatttgaacaactgtgtgcttcccttttggccagggttgaaccacctttaaaagcagtaatggaacaagctaacttacaacgtgaagacattagtagtatagaaattgtaggaggagcaacacgaattcctgcagtgaaagaacaaatcactaaattctttcttaaagacataagtaccacattaaatgctgatgaagctgttgcaagaggatgtgcgttacagtgtgcgattctctcaccagcatttaaagtgcgtgaattttccataacagaccttgttccctattcaatcacattaaggtggaagacctcttttgaagatggaagtggggaatgtgaagttttctgtaagaaccatcctgccccattctcaaaagtcattactttccacaagaaggaaccatttgaactagaagcattttatactaatttacatgaagtgccttatcctgatgcaagaattgggagcttcactattcagaatgtttttccacagtctgatggtgatagttccaaagtgaaggttaaagttcgtgttaacatccatggaatcttcagtgtggctagcgcatcagtaattgagaagcaaaatttggaaggcgatcacagtgatgctccaatggagacagaaacttcatttaaaaatgaaaacaaagataatatggataaaatgcaggttgatcaagaagaagggcatcaaaaatgtcatgctgaacacactccagaagaggaaattgatcatacaggagccaaaacaaagtcagctgtctcagacaaacaagaccgattaaatcagacacttaaaaaaggaaaagtcaaaagtattgatctaccgatccagagtagcctatgtagacaactaggccaagatcttctcaacagctacattgaaaatgaggggaagatgatcatgcaagataagttagagaaagaaagaaatgatgctaagaatgccgttgaagaatatgtatatgattttagagacaggctgggcactgtctatgaaaaattcatcactccagaagacttgagtaaactgtctgcagtattggaagacacagaaaattggctttatgaagacggagaggaccaacctaaacaagtttatgtggataagcttcaagaactaaagaaatacggccagcctattcaaatgaagtacatggagcatgaagagagaccaaaagccttaaatgacttgggaaaaaagatccaacttgtcatgaaagtgatagaagcttatagaaacaaggatgaaagatatgatcatctggatcctactgaaatggaaaaggttgaaaaatgtatcagtgatgccatgagttggctgaatagtaagatgaatgcacagaacaaactaagtctcactcaagatcctgtggtaaaagtttcagaaatagtagcaaagtcaaaggaactggataatttctgtaaccccatcatttacaagcccaaaccaaaagcagaagttcctgaagacaaaccaaaagctaatagtgaacacaatggcccaatggatggacagagtggaactgaaactaaatcagattcaacaaaagacagctcacagcatactaaatcctctggagagatggaagtggactaagtcttaattttaccttcacattaattcaaaccgtgcaagtaaccacggggtccatcttttacatctggtacacacaacagacgctcagttgttcttaaccacttttgtcatttgttttttggagtagttttgaaaagtgttttatattgagtgcacttctgttcattt

SEQ ID NO: 3276 - DNA, 5512 bp, Homo sapiens
agcgggccgtcggttgggcgcagacaggccgcagaagatggagagatggagccaccccaagagacaaataggcctttcagcacacttgataaccgcagcgggcaggtccaagtcctgtccgccaccccgctattgcagaggaatccctacagcagcccggatatcatgcacattaaagggtcggaggcttcttcggtcccttacgccctgaaccagggcacgacggccctgcctaagaacaagaaccaggagggcaccgggcaccggctgctgaacatgctgagaaaaactcttaaagagtctgatagtgaagaactggaaataacacaggagacgccaaatttggtgccatttggggatgtggttggctgcctgggcattcatataaagaactgcagacattttatgcctaagatcagtttacaacattatgctaatttattcattcgcatctctataaacaaagctgtgaaatgtacaaaaatgtgtagcttgctatccaaaaacgatgagaagaacactgtaattaagttcgatgaagtgaagtatttttctgtacaggttcccagacgttatgatgataagcggaataatattttattggaactcatacaatatgacaatagagaaaaacgtgctttcttgttagggagtgttcagatacatctttatgaggtaattcagaaagggtgcttcattgaagaggtccaagtgttgcatggaaacatatttgtctgcaggctggaggtggaatttatgttctcctatggaaactttggttatggattttcacatcagttaaaacctcttcagaaaattactgagccatccatgtttatgaatcttgcaccacctccagaaagaacagatcccgtgacaaaagttattacaccacagacagtagaatatccagcattcttatccccagacctgaatgttactgttgggactccagctgtgcaatcctccaaccagccatctgtagtgcgacttgaaaaacttcagcaacaaccccgggaaaggctggaaaagatgaaaaaagaatatagaaatctgaatacatggatagataaagctaactatttagaaagcattctaatgccaaaattggaacataaggattctgaggaaactaatatagatgaggcatctgaaaacacgaaaagtaatcatcctgaagaggagcttgaaaatattgtaggagtagatatccctcttgtaaatgaggaagctgaaactactgcaaatgagttactggataatgattctgagaaaggcctgactataccaactttgaaccaatcggaccaagataattcaactgctgatgcttctaaaaatgatgaatcaacaccttcacccacagaagtgcactcattgtgcactatttctaaccaggaaacaataaaagcaggcagaataccacctttaggtgaacgtcaatcagaaagcatgccagacagaaaaatgaaaaatgtattttttccattagaagtaaaattaaaagataactatccaagcattttaaaagcagactcatctctatcagaggtggctttttcaccaaaagaatataattcaccatctttcagaccagaatatatagaattcaaaccaaaatttcagtttcagaaattcaacaagaacggttttgatccttttctaaggaatataaacaaaatgtcagtcagaaaaagaaaagatcaagatatatacaaatatagaaatatcttaggtgcagaggtcatagagcatgaagaccaggatcctccttatccagcacaatcaaaaactgcaggacctgctaatacaacctgggcccatgaccctaatatcttcacaacaaagatgttagaaactgagaataagttagcccctgatcctactatcaatacaataaagggtttagatacaaagaatagtttaaaagaaaatctaccaaatgtatctttaccaagcatcaaaggagaatcatcaagggctggaaatgtacaggcaaacacatgtcacctctcgaagtctttaaattttaccccccatatagaatatttaaaacaatcaatgatactcaagtcaattttaagtgaaaatctgcaagacctttcagacaaattattttctaaaccagaagttagtatgaacagtgaagcaagagagaaaagtagttctccacttctaagcattcatgataaatcatcaagtagtatggaagacaacgtattggaaaaaaaacaagatttaaacaactggctttcagaaaaagacattttaaattcaaagactactttaagtcaaataattaaaaatattcctgcagattcattttcagaaggtagtcaaataattgaaaatattcctgcagattcacttttagaaggtggtcaagtaattaaaaatattcctgaatattcactttcagaagggggtcagataattaaaaatattcctgcagattcatttttagaaagtggaccaggacaatctccagaggtagaagaacatgtctctaaaaaacacttcgaagctgatgagagagattttccaattaaaaaaaatagtagtaccaaaaagaaacatttaataagcgaagtacctaactccaaatcaggttcaagtggcactgtacatgactacattatgaggcaaatattcactgcaccaatattctcagaattggagatagaagtgaaagagccaagtgaaacaccaatgaacttggaaaatcaattacctacaccttggaagagaagtttgtcatcacatattctatttcatgaagaaaatgctgatgaaatagaattgccacagcccagatctgctacaagccagataatacaagcatttcctatagatacacttttagaatctgggataatcaaagtgatagaattagataaagaacaccataagagttctttgctgggtacggggatcacttctcctaaaggaaacctaaaggattcccaagagtattattcagaaatcagaagcgagacagaacctctttctgagcagagtatacccatcattcccaaagacactacttctgttagtagagctgaatttatacaggaagaccaaaatatgttcccacaagattcaagttattattcaatagcaaataaagaactgtatttgccaagaaatggtcagaggctttgtaaagacaaaaatgatctcagttctactttagaaagtttaactaactcattaatggataaacttagtgaatcagatgaaataatgttaaaatcctttttaaaaaacatcttcaatgtttttttcaaatataatcattctgaaagaagaggacaaccagaaaaagaattagaaagactaattcaaccttcttttacaagtgacacagaacaccttgaagaactccaagaggattttgataaagcagacaaattagacagaaaacctattttgagtccaaagttgcgtgtgtttctagaagaactctcagagtcagaagtaaaacatttaaaatctgaattaagtaaacaaatccagcattaccttgtagaaagactttcagaatcaggacatatcaccaaggaggacttaccaaaaatctatcaaaatctgtatctgatgaatgagaaagcagagcagaaagggccaaacagttttcaggggaaatattctgaaactgtgaaagaaatcatgtcttttgtcaacaatttcaatcatcatttcatagataaacatttggaaataaagctgagatcttttttaaaagagattctccaaaactatttcctaaaaaacatttcagaaagcagtttatttaatgagacagcatctgagactatatacccaaacatatcttctctaaggactaaaagtgtctcaatatcttttcatgaactagaacaagatatttcaaaggggagttttggtagaaggtttgaaataaacatgaaatatcctttaagtaaatctctacaaaactatctgatagctttatcagaaaatgaattattacatctaaaagctgatttaagcaaacacctccagagtctttttatagaaaaactttcaaaatcaggactaatgacaaaaaagcaattagaagggatcaaccagcatataaatttgcttaattctagttctataccattaaaatatataaaaacacatttaccttttagagatgactgtcactttgtggagaagcattcagaaaagcaaaataaatattcaagaattgttcaacaaaccactttacaaacggtttctgaggataaacttagagaagcagaattgattcgagagaaagaaaagaaatattttcccttacagaatttaaagggaaattcatctttaattaaggaacagaaaagttattacactaaggaagaagctaaaacaccaagtttaatcaaagtacaaccttcttccaatgaaaatatccaggcaagtccattaagtaagtcatcagaaatacttacagatatactgcttaagaaactaaggaaagaacatgtattcacgcagcttcctcaagcagaaaattctgttcataaaacagagattcaagacccatatagttggggtggtaaatcaaaaataactcaatcaaaagcttggtgtgaaaagacactgaaaatgaagtcccttgatagaaaggagcatgtaaacatctataaatggactgttcaggaaaaacctgaagcagtattaacatcgtatccaagaattcctaatgccagaatgccaagggaagatgagtacttaaacagaatcactttcccttcctggcaaagtagcactttaactcatttcaatacagagactggggaaaaatcaaaattagaagaccagtattgtcagacattgaaaggaaataataacaataataaaaagcatttagtaacatttgcacaatacaaaaaagaaatacaaactctttatataaaaccagatgaaatttgcagtgaaaaatgtgccaagttccctgaaatacagtcattccaatataaggttgtagaagatgagaaaaacttgaaaccacacctcttcccagaattatttaagatagaagatctaaaacccaaggtccgaaaagaaagagaccgtgtcgcccaaccaaaaaagtcatttaacaagatagtcaggatactaccaaccacactgcccaccacaagaattcacctaaagaagtctgttccaaggacactgcttcactggactgcaagaagaactatacatgattgttcagataaatttgaggatttacatgacatgacctcatttacacaccttaaaaaagtaaaatcaagatcaaggcttttaggaaaaagctcagatgatatccataaccatgccagacactctgcaagaccatatactgctccggaggttaacaagcaacgagaaagctacagtggaaagtttacaagtcgtcgaatggtttcatcaggcttagttcatataaatgataaaacatcagattatgaaatgcataaaatgcggccaaaaaaaattaaaagaggatattgaaaaa

SEQ ID NO: 3277 - DNA, 1166 bp, Homo sapiens
gccaaatcttaaaggatccgggagctaagccagacccgggtggcggtggcagctgcgaaacccagggagccgatgccacgtgacccaatgtggacttcttttaaacctttctaatgcccataacccagcctcagacccatggagcccacgagagactgcccgctgttcgggggcgccttttccgccatcctccccatgggggccattgacgtaagcgacctccgaccggtcccggacaatcaagaagttttctgccatcccgtgacggaccagagcctgatagtggaacttctcgagctgcaggcccacgtacggggcgaagcggctgcgcggtaccactttgaggatgttggtggcgtgcagggggctagggctgtccatgtggagtctgttcagcctctcagtttggagaacctggccctgaggggccgctgtcaagaagcctgggtcctctctggcaagcagcagatagctaaggaaaaccagcaggtgagggcccgagagtgtgtaatgtcctggaagggcggtagcggggacgcagagatccaggtaagcatcctgactctgatccccttaggtagcaaaggacgtgacacttcatcaggccttgctgaggctgccccagtaccagactgatctcttgcttaccttcaatcagcccccgtaaggaggaaggaacgggcgggtatctcatgactgggttcccaggagaatcgggctgggagggacagaacagggagactcactggtgggatcctccaaggaagcaggagtgggccagaggtttggggtaactgatacccaggtcctctggggaacaggaattggcaatttccaaacctcaggcctggatgatgttctgtctccatctgttcccccaccccaagccctgacaacaggtcatctcttggccccgaaaatctgtcacctgcaccctggagcctgggtgactttgaacagctggtgaccagtctgacccttcacgatcctaacatctttggtccccagtaaaggcgctgaagcactgcatgatgttgctgagaacttggggactcggttctgtgagggggaaaagaggttgaaaagagggtttcctcttatttcttccctgtgcgtaaacataagacaatccctcttcagaataaacttgctttataatcaatata

SEQ ID NO: 3278 - DNA, 6053 bp, Homo sapiens
tggagaacgggtggacgtgcaggccagaacccgggacccacccggctgagcccccagactctccgctgcccacgaccctcggagtggcaccctctcctggccgtctcctctcgtgggtcccgaagaacgggtgcaaagccgagttcgtccgctgtactgcgcgggcgcgcgtttcgttcttcggttttgccacggttctgtgactccctaaaggttgagggctactgaattagaagaaacgccgagctggcttctggtgggctgccgggcgccgggcagcgtgcttggactggggagggcagggcgtgtttactctgagtagagcaaccgcaagacctcctttaaaaaataccagttctgagcttcggcattggagaggccgcctgtcattcagcctcttcggaccctctctcactccctgtcttccggagcgtgagtgaagcccgggtgaggtgttttcccacacgccgggggcccggagctgagaaggggcatggccagcatcacgcagctgttcgacgacctgtgtgaggccctcctgccggctgccaagactcacctgggccagcgcagtgtgaaccggaagagggcaaagcggagcctcaagaaggtggcctacaatgctcttttcacaaatctttttcaagatgagactcaacagctgcagcctgacatgtcaaaactaccagcgagaaacaagatcctcatgttgtcctttgacttgagagtgggtggcctgggccccaaggccgaccgtttggaggagcttgtggaggagctggaagcagccccttgctgtccgcttttggaggtggggtctgttttggacctcctggttcagctggcagggagtggtccccctcaagttctgccgagaaaacgagactacttccttaacaacaagcatgtggggagaaacgttccgtacagcggctatgattgcgacgacctgagtgtgtttgagatggacgttcagtctctgatctccagagaagagtgtttgtgtcacagcatgatccaggaaacacttcaggttatggaggctgctccaggcactggcctgcccaccgtcgggctcttctcatttggtgacccttgtggtgacaggttcgagagagacacccgggtctcgctcttcggggcccttgtgcacagccgcacttatgacatggacgtccgactgggcctgccccccgtgccagacaatgcggacctctctgggctggctattaaggtcccaccgagtgtggatcagtgggaagacgaaggattccagtcagcgtccaacttgactcctgattcccagtctgagcccagcgtgaccccagacgtggacctgtgggaagccgcacttacctatgaggccagcaagcggaggtgctgggagcgagttggctgcccccctggccacagagaggagccttacctgacggaggcgggaagggacgctttcgacaagttctgcaggctccaccaaggggagctccagctgcttgctgggggcgtcctacaggccccgcagcccgtgctggtgaaggagtgcgagctggtgaaagacgtgctgaacgtcttgattggggtcgtgtctgccacgttttcgctctgccagccggcccaggcctttgtggtgaagcggggcgtccacgtgtcaggagcgtctcccgagagcatcagcagcctgctctcggaagtggccgagtatgggacctgctacacgcgcctgagtcatttctctctgcagcccgtcctggactctttgtacagcaagggcctcgtgttccaggccttcaccagtggcctgaggaggtacctgcagtattaccgggcctgcgtcctttccactccgcccaccctgagcctcctcaccattggttttctcttcaagaaacttggccggcagctcaggtacctggccgagctctgtggcgttggcgctgtgctcccgggcacctgtggaggaggccccagggccgcgtttcccaccggcgtgaagctgctgtcctacctctaccaggaggctctgcacaactgcagcaacgagcactaccctgtactgctgtccctgctgaagaccagctgcgagccctacacccggttcatccacgactgggtgtacagcggggtgttcagagacgcttatggcgagttcatgattcaggtgaaccacgagtacctcagcttccgagataagttgtactggacacatggctacgtgctcatctccaaagaggtggaggactgtgttcccgtgtttctgaagcacattgcccacgacatatacgtctgcggaaagaccattaacctgctgaagctctgctgcccccggcattacctctgttggtccgacgtccctgtcccccggatctcggtgattttctcccttgaggagttgaaggagattgagaaggactgtgccgtctacgttgggcgcatggagagggtggcccgccacagctctgtcagcaaggaggagaaggaattacgtatggaaattgcaaaacaagaattaatcgctcatgcccgggaagcagcatccagggtcctgagtgcactgagtgaccggcagatgtcagaacggatggccttggatgcccggaagcgtgagcagtttcagaggctgaaagaacaatttgtgaaggaccaggagcgacgccaggcggccaggcaggaggagctggatgatgacttcagctacgcccgtgaactccgagacagggagagaaggctgaagtccctggaggaggagctggagaggaaggcgaggcaggcactggtcgaccactacagcaagctctctgcagaggcagctcgtcgggagcagaaggcactgtggagaatccagaggcaccgactggagagtgcacggcttcgttttctcttagaagatgagaaacacattcaggagatgctgaaagcagtgtctgaggctcaccagccccaggagccgccagacgtcctcttgagcgtgcacccccaggtcacgtctccgggccctgagcacccagagggaggccaaggctgtgattctgggtctgcagagcaacactcgcctgcctgggatggctggaacaggccaggcctgctgaccccacagccccttaagcctctagcagtgggggctggtggcagggggctgcagcaggcggagggggccagacccttctctgacagcctcagcattggagacttcctacctgtgggcccaggggctgagccgtccgtgcagactggcatggtccctctcctggaggtggcgctgcagaccattaacttggacctgcccccctcagctcctggggaggcacccgcagcagccagcactcagccctccaggccacaggagtacgactttagtactgtcctgaggccagctgtggccacctcacctgcaccagggcccctgcaggctgcagagtgcagcttgggcagctcagggctacagctgtgggaggacagttgtgggaagatggatgcctgtggctccgcctcgcgggagactctgctcccctcacacccacccaggcgtgctgctctggaggaggggagcagccagcccacagagcggctctttgggcaggtgtcagggggtggtcttcccacaggggactacgcttctgaaatagctcccacccggccacggtggaacacccacgggcacgtgtctgacgccagcatcagggtcggggagaatgtgtcagatgtggctcccacccagccacggtggaacacccacggacacgtatccaatgccagcatcagcttaggggagtctgtgtcagatgtggctcccactcggccacggtggaacatccatggacatgtgtccaacgccagcatcagggtcggggagaatgtgtcagatgtggctcccaccaggccacggtggaatacccacgggcacgtgtccaacgccagcatcagggttggggagaacgtgtcggacgtggctcccacccggccacggtggaacacccatggacacgtgtccgatgccagcatcagcttgggggagtctgtgtcagacatggctcccgcccggccacggtggaacacccatggacacgtgtctgatgccagcatcagcttgggggagtctgtgtcagacatggctcccacccggccacggtggaacacccacggacatgtgtctgacaccagcatcagggttggggagaacgtatcggacgtggctcccatccggtcacggtgcaacacccatggacacgtgtccgacgccagcatcagcttgggggagcctgtgtcggatgtggtttccacccggccacggtggaacacccatgtacccatccctccgccccacatggtgctgggggctctctcaccagaagctgagcccaacacacccaggccccaacagagcccccctggccacacgtcccagtcagcgctcagcctgggagcacagagcactgtgctggactgtgggccacggctgcctgtagaagtggggccatctctgtcctcccccagctcgggctgcggggaggggagcatcagcgtgggggagaacgtgtcagacgtggctcccacccaaccatggtggcccaacaccccgggagacagtgtctctgaagaactaggtcagagtagggtggctggtggtcaggagtgggactgtgggacgcacagagcctgggaggccctgggaggagcggggacactgaggacctctctccaaattggcctctcaactcacaggaagacacagctgcccagagcagcccaggccgtggtgaggaggcggaggcatcggcggcggaggctcagggtggggagcaggcctacctggcaggcctggcagggcagtaccacttggagcggtacccggacagttacgagtccatgtccgagccgcccattgctcatcttttgcgccccgtgcttccccgggccttcgccttccccgtggacccccaggtccagtctgccgctgatgagactgctgtgcagctgagcgagttgctgacgctgcccgtgctcatgaagcgctccatcacggcaccgctggccgcccacatctccttggtgaacaaggccgctgtcgactacttcttcgtggagctgcacctggaggcgcactatgaggcactgcggcacttcctgctgatggaggacggcgagttcgcccagtccctcagcgacctgctctttgagaagcttggagctgggcaaacgcccggagagctgctcaacccgctggtgctgaactctgtgctgagcaaggccctgcagtgcagcctgcatggggacaccccgcacgcctccaacctctccctcgctctcaagtacctgcccgaggtgtttgcccccaacgccccggatgtgctgagctgcctggagctcaggtacaaggtggactggcctctcaacattgtcatcaccgagggctgcgtgagcaagtacagcggcgtcttctccttcctgctgcagctgaagctcatgatgtgggcgctcaaggacgtctgcttccacctcaagcgcacagccctgctgagccacatggccggctctgtgcagttccgtcagctgcagctgttcaagcacgagatgcagcatttcgtgaaggtcatccagggctacatcgccaaccagatcctgcacgtcacctggtgcgagttcagggccaggttggccaccgtgggcgacctggaggagatccagcgtgcgcacgcagagtacctgcacaaggccgtcttcaggggcctgctcacggagaaggcggcgcccgtcatgaacgtcatccacagcatcttcagcctcgtgctcaagttccgcagccagctcatctcccaggcctgggggccccctgggggcccgcggggtgcagagcaccccaactttgcactcatgcagcagtcctacaacaccttcaagtactactcccactttctcttcaaagtggtgaccaagctggtgaaccgcggctaccagccccacctggaggactttctgctgcgcatcaacttcaacaactactaccaggacgcctgaggctgctctgcgggggacgtgcacaataaaggtgttctcgg

SEQ ID NO: 3279 - DNA, 2398 bp, Homo sapiens
gagacctggcggaccccgttgctagagcggcagattgcggctcaagcgtctgagaaaatctaggctggggtcgagagtccgcaacagtggcacctggagccagacccaccgctttctggtgtcgcgcctttcaacccgggggggtaggaagctttctgttgctccgcataactgtggtcagctaatagctgctgcctttccgagacagttgtcttatggagttgcttggagaacgtaaaataagaggcctaagcaatgcgtctgatgtacacctgtcgtggaataactgttcccgctcattcggccgctgtacctctgctccctcattcggagcgtagctgggtatgaatgaaattccgggcttgtagcacagagaaaacttctctcccacaattggttggtgctggggaggaagctcctgattggtggaaagtccgaggaagtgggcaagccggagggatttcgtgtacctcaggtgccctcactctgaccggccccctatcattacgtaattttctacgactcgcggtagctcaggcagagcgggttcctgcagcggcgcgaccctctgacgtctccgcttctaattggtcaagagctgcgactgcagttctgaagcctaactggttgcccgtgccgcctcggaggtgaagtgtactgcgctgattggcttccaggcgccggccgcgtgtgatgtcccgggcaacgattggctctcgcctaccgggggcttctctcaccgggactcgggactcccgggaagtggaccggcagaagagggggctagctagctgtctctgcggaccaaggagacccccgcgcccccccggtgtgaggcggcctcacagggccgggtgggctggcgagccgacgcggcggcggaggaggctgtgaggagtgtgtggaacaggacccgggacagaggaaccatggctccgcagaacctgagcaccttttgcctgttgctgctatacctcatcggggcggtgattgccggacgagatttctataagatcttgggggtgcctcgaagtgcctctataaaggatattaaaaaggcctataggaaactagccctgcagcttcatcccgaccggaaccctgatgatccacaagcccaggagaaattccaggatctgggtgctgcttatgaggttctgtcagatagtgagaaacggaaacagtacgatacttatggtgaagaaggattaaaagatggtcatcagagctcccatggagacattttttcacacttctttggggattttggtttcatgtttggaggaacccctcgtcagcaagacagaaatattccaagaggaagtgatattattgtagatctagaagtcactttggaagaagtatatgcaggaaattttgtggaagtagttagaaacaaacctgtggcaaggcaggctcctggcaaacggaagtgcaattgtcggcaagagatgcggaccacccagctgggccctgggcgcttccaaatgacccaggaggtggtctgcgacgaatgccctaatgtcaaactagtgaatgaagaacgaacgctggaagtagaaatagagcctggggtgagagacggcatggagtacccctttattggagaaggtgagcctcacgtggatggggagcctggagatttacggttccgaatcaaagttgtcaagcacccaatatttgaaaggagaggagatgatttgtacacaaatgtgacaatctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggtatacaatggactgcaaggatattgagagtgaataaaattggactttgtttaaaataagtgaataagcgatatttattatctgcaaggtttttttgtgtgtgtttttgtttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgtttttaaatacattttgttgttatttttttcatga

SEQ ID NO: 3280 - DNA, 3216 bp, Homo sapiens
ggcctggagttccggccaggccactgcttgggaagcaagaaggtgaaggcacctctgctgggccaagcactcttagggccgaggggcactgcagctgacaagagctccctgtttcgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagaacatgcccaatgtccgtgatcatgatgcctctgtctacctccgcctccaaggggatgccttgtctgtgggtggctatgaggccaaccccatcttttgggaggaggtgtcagacaagtttgccttcggcctctttgacctggactgggaggtgttcacccagcacattgaaggcgccatcaacagggtccccgtgctggagaagacaggaatcaagtccacggtctgcggccctgaatccttcacgcccgaccacaagcccctgatgggggaggcacctgagctccgagggttcttcctgggctgtggcttcaacagcgcaggaatgatgctgggtggtggctgtgggcaggagctggcccactggatcatccatgggcgcccggagaaggacatgcatggctatgacatcaggcgcttccatcactcgctcacggaccacccccgctggatccgagagcgaagccatgagtcctacgccaagaactactccgtcgtcttcccccacgatgagccgctggccgggcgcaacatgaggagagacccgctgcacgaggaactccttggacaaggctgcgtgttccaggagcggcatggctgggagcgaccgggatggtttcatccccgaggcccagctccggtcctcgagtacgactactacggggcttacgggagccgcgcgcacgaggactacgcctaccgcaggctgctggcagacgagtacaccttcgccttcccgccccaccacgacacgatcaagaaggagtgcctggcctgcagaggggccgccgctgtgtttgacatgtcctacttcgggaagttctacctggtggggctggatgcaaggaaggctgccgactggctcttctccgcagatgtcagccgacccccaggctccaccgtgtacacgtgcatgctcaaccaccgtgggggcaccgagagtgacctgactgtcagccgcctggcacccagccaccaggcctccccgctggcccccgcctttgaaggggacggttactacctggccatgggcggggccgtggcccagcacaactggtcccacatcaccaccgtgctgcaggaccagaagtcccagtgccagctcatcgacagctccgaggacctgggtatgatcagtatccagggcccagccagccgagccattttgcaggaggtgctggacgcagacctgagcaacgaggccttcccgttctccacccacaagctactgagagccgcagggcacctggtccgagccatgcggctgtcctttgtgggggagctgggctgggagctgcacattccaaaggcgtcctgcgtgcctgtgtaccgggctgtgatggccgcgggtgccaagcacggcctcatcaacgcagggtaccgcgccatcgactccctgagcattgagaaaggctaccggcactggcacgcggacctgcggccagacgacagccccctggaggcaggcctggccttcacctgcaagctcaagtcgccggtgcccttcctggggagggaggccctggagcagcagcgggccgcaggcctccgccggcgcctggtgtgcttcaccatggaggacaaagtacccatgtttggcctggaggccatctggaggaacggccaagtggtgggccatgtccggagggctgactttgggttcgccatcgacaagaccatcgcctacggttacatccatgaccccagcggtgggccggtctcgctggactttgtgaagagcggggactatgccctggagagaatgggggtgacctatggtgcccaggctcacctgaagtcgcccttcgaccccaacaacaagagggtgaagggaatctactgagggctcagaccacatgccccatcccatgctgtccatccattctcacaggtcccaaatggccctgggtcccaggaccctggacccagccagaacttgtgccctccctgtccttagcctaggcctagtcctgcgaaaacccccaaaccagatacggacagagaccaagatggcccatcctgtggtcactgactggaaggcagtctctaatccaccccaatcctcccagaaagcaaacctgtaagtgtcttgggctcagggaccatggcttgtagccctttccaagcttctagaaggtgcttagtaaatacttgataagccccacgtg

SEQ ID NO: 3281 - DNA, 222 bp, Homo sapiens
atgtcttaccagcagcagcagtgcaagcagccctgccagccaccacctcctgtgtgccgcctgccaaagcgtccagagccatgtccacccctgaagtgccctgagccctgcccaccaccaaagtgtccacagccctgcccacctcagcagtgccagcagaaatatcctctggtgacaccttccccaccctgccagccaaagtgtccacccaagagcaagtaa

SEQ ID NO: 3282 - DNA, 1832 bp, Homo sapiens
agctgccagcccgccaagacccagacctgggaggggaggcccctcctgttagcccagagggaaagaaagaactggggcgatccgggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaataataaacccagggagaagtcagaaagtaacaagaggaaatccaatttctcaaacagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagctaaaggaggggatggtctctgtcatttctctttgtacataatacattcacctccctgcctcctctcctttctacccacccctttctatcctaaacacatccataaaaaatgtgcttatcactgtgctccacaggagaaatgttggtattggttctcttgtaacataactgatggtctgattaatgataagtgtctctctgtgaagaccaggcatttacatactgagtgtaatacccacaatttttttttcctttgccctgatctcttccttctgcttccctgtgacctcaagatgagtttcaactttttaatcaccttagagtcttgatcttttcagggttggtcgctttttaggttgggggattttgttacaatgatgttgaattttggtttcttgctttggttcttagaacatgttgctgactagctggcctttgttctgacatgttgagatggaaaggatgttgcccatctgttaaaaagccaatagcaactgcctacctgttggggctttcccaaccttgttcagctctacccaggagaatacagggtttctggtgtggtcttctgggccaccctctgttgttcatcctcactcatcctcccagaattactccatcctttggaagatttgaaattttacactgaaatctgtcaagacactctttttagccccaggactttcggtattgcttttagcactccccacttctgcttctgtaaagtgatatcaatttgtgataaaatgacaagattattaactgtgcagatttgtagctatagtacatgaggatgatggggtagggtacaattgtctttattatcatatatggtatgtatgtatgatttctttccattcctcatatttagactgtatatttatgtaggtgtgagtgattgcctggtgcttgcttgtgccaaggtgctaggcaccctccaaccctgccaacttttgtggcctcccaaagcattcctgttaccaaagaggcttcaaacctgaccctcacttctcagtggacccgagtttcccttccatgccattattttcagtggggaagttttagaggtgagctgttggccacaatatcaattttaagtgttcatagcagttatgtctcctgcattcttggctc

SEQ ID NO: 3283 - DNA, 308 bp, Homo sapiens
ggggcagggctggtgagcaagcccgcggggagcgagcgcggaggcgggcgttgctacggcaacgtatattttgaatacatctgtcttcataaaatacaccatgtccaaaatctaaaagggccaattccaaattattccaccagctttgaagggaattgaagcaagaataacaagacagaagaatagaaggaaggtgataggatgtgatgatagaatttgtgatagccaagcaacaacttttcctaattcggcatgttaaaaaataagggtcactcatctaagaaagataacttggcagtcaatgcagt

SEQ ID NO: 3284 - DNA, 1045 bp, Homo sapiens
tagtcaggcgaagtttgcagaatggaatctaattttaatcaagagggagtacctcgaccatcttatgtttttagtgctgacccaattgcaaggccttcagaaataaatttcgatggcattaagcttgatctgtctcatgaattttccttagttgctccaaatactgaggcaaacagtttcgaatctaaagattatctccaggtttgtcttcgaataagaccatttacacagtcagaaaaagaacttgagtctgagggctgtgtgcatattctggattcacagactgttgtgctgaaagagcctcaatgcatccttggtcggttaagtgaaaaaagctcagggcagatggcacagaaattcagtttttccaaggtttttggcccagcaactacacagaaggaattctttcagggttgcattatgcaaccagtaaaagacctcttgaaaggacagagtcgtctgatttttacttacgggctaaccaattcaggaaaaacatatacatttcaagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggttactgtgcataatgatagtgatgatactctttatggaagtttaactaactctttgaatatctcagagtttgaagaatccataaaagattatgaacaagccaacttgaatatggctaatagtataaaattttctgtgtgggtttctttctttgaaatttacaatgaatatatttatgacttatttgttcctgaattagctaaaaccaaaggagaattaatcaaaaccaaagaagagttaaaaaagagagaaaatgaatcagattcattgattcaagagcttgagacatctaataagaaaataattacacagaatcaaagaattaaagaattgataaatataattgatc

SEQ ID NO: 3285 - DNA, 199 bp, Homo sapiens
ctcggcttcccaaaatgttgggattacaggtgggagccaccatgcccggcctgtaaccctaattattaaataatttgctgtggaatggattctaatattcaataatagaagttgtaattctgaacccttggaaatggaggaaggctagaggatatgataaaggagtccaaggagcatggcggacaccgacctgttcatg

SEQ ID NO: 3286 - DNA, 6388 bp, Homo sapiens
gttttgatgaacacctggctttattcttgcaatgaagaaaggttctcaacaaaaaatattctccaaagcaaagataccatcatcatctcactctcctatcccatcatctatgtccaatatgagatctaggtcactttcacctttgattggatcagagactctaccttttcattctggaggacagtggtgtgagcaagttgagattgcagatgaaaacaatatgcttttggactatcaagaccataaaggagctgattcacatgcaggagttagatatattacagaggccctcattaaaaaacttactaaacaggataatttggctttgataaaatctctgaacctttcactttctaaagacggtggcaagaaatttaagtatattgagaatttggaaaaatgtgttaaacttgaagtactgaatctcagctataatctaatagggaagattgaaaagttggacaagctgttaaaattacgtgaactcaacttatcatataacaaaatcagcaaaattgaaggcatagaaaatatgtgtaatctgcaaaagcttaaccttgcaggaaatgaaattgagcatattccagtatggttagggaagaagttaaaatctttgcgagtcctcaatttgaaaggcaacaagatatcatcgctccaagatataagcaagttgaaaccgcttcaagatttgatttctctgatcctagttgaaaatccagttgtgacccttcctcattacctccagtttaccattttccacctccgttcattggaaagtttggaaggtcagccagtaaccactcaggatagacaggaggcttttgagagattcagtttagaagaggtagaaagactggaaagagacctagaaaaaaagatgatagaaactgaagagcttaagagcaaacaaacaaggttccttgaggaaattaaaaatcaagataaattgaataaatcattaaaagaggaggccatgttacagaaacagagctgtgaggaactcaagagtgacttaaacacaaaaaatgaattgctaaaacagaagaccatagaattaacacgagcatgtcagaagcaatatgagctggaacaggaattggccttttataaaattgatgctaaatttgagccactaaattattatccatcagagtatgctgaaattgataaagccccagatgaaagcccttacattggcaaatccagatacaagagaaatatgtttgccacagagagttatattattgacagtgctcaggcagtacagatcaagaagatggagccagatgaacaacttagaaatgatcacatgaacttgagaggccacacaccactggacacgcaactggaagacaaagaaaaaaaaataagtgcagcacaaactcgactatcagaactgcatgatgaaatagaaaaggcagaacaacaaattttgagagctactgaagaatttaaacaactggaagaagctatacaactaaaaaagatttcagaagcagggaaagaccttctttacaagcagttgagtggtagactacaacttgtaaataaattacgccaggaagctctggatctagaactgcagatggaaaagcaaaagcaggaaattgccggaaagcagaaggagattaaggacctgcaaatagccatagatagcctggattccaaagacccaaaacattcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaagacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgaactaaagaatattctggacatgttgcaacttgaaaaccatgagctacaaggtttgaagctacaacatgaccaaagggtatctgaattagagaagactcaggtggcagtgctagaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttacagctagagaagctgaggcccagaagctcaagaaacaggtgtgtgcccagaaagcccagctggccagcctggggagagag

SEQ ID NO: 3287 - DNA, 1639 bp, Homo sapiens
agacaggccgcagaagatggagagatggagccaccccaagagacaaataggcctttcagcacacttgataaccgcagcgggcaggtccaagtcctgtccgccaccccgctattgcagaggaatccctacagcagcccggatatcatgcacattaaagggtcggaggcttcttcggtcccttacgccctgaaccagggcacgacggccctgcctaagaacaagaaccaggagggcaccgggcaccggctgctgaacatgctgagaaaaactcttaaagagtctgatagtgaagaactggaaataacacaggagacgccaaatttggtgccatttggggatgtggttggctgcctgggcattcatataaagaactgcagacattttatgcctaagatcagtttacaacattatgctaatttattcattcgcatctctataaacaaagctgtgaaatgtacaaaaatgtgtagcttgctatccaaaaacgatgagaagaacactgtaattaagttcgatgaagtgaagtatttttctgtacaggttcccagacgttatgatgataagcggaataatattttattggaactcatacaatatgacaatagagaaaaacgtgctttcttgttagggagtgttcagatacatctttatgaggtaattcagaaagggtgcttcattgaagaggtccaagtgttgcatggaaacatatttgtctgcaggctggaggtggaatttatgttctcctatggaaactttggttatggattttcacatcagttaaaacctcttcagaaaattactgagccatccatgtttatgaatcttgcaccacctccagaaagaacagatcccgtgacaaaagttattacaccacagacagtagaatatccagcattcttatccccagacctgaatgttactgttgggactccagctgtgcaatcctccaaccagccatctgtagtgcgacttgaaaaacttcagcaacaaccccgggaaaggctggaaaagatgaaaaaagaatatagaaatctgaatacatggatagataaagctaactatttagaaagcattctaatgccaaaattggaacataaggattctgaggaaactaatatagatgaggcatctgaaaacacgaaaagtaatcatcctgaagaggagcttgaaaatattgtaggagtaggtggctttttcaccaaaagaatataattcaccatctttcagaccagaatatatagaattcaaaccaaaatttcaggattgttcagataaatttgaggatttacatgacatgacctcatttacacaccttaaaaaagtaaaatcaagatcaaggcttttaggaaaaagctcagatgatatccataaccatgccagacactctgcaagaccatatactgctccggaggttaacaagcaacgagaaagctacagtggaaagtttacaagtcgtcgaatggtttcatcaggcttagttcatataaatgataaaacatcagattatgaaatgcataaaatgcggccaaaaaaaattaaaagaggatattgaaaaatgttcgctcatttgtgatattataaaacatgtttaactcagaatgatatgtgaggccagcagtcagaatatcacttctccatt

SEQ ID NO: 3288 - DNA, 565 bp, Homo sapiens
aacagattgtgggctcccagggcatatgtctgcacgctgaggccgaggcggagaaggggcttcctgagcgtcccagtacactgacagagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccgg

SEQ ID NO: 3289 - DNA, 1468 bp, Homo sapiens
gttcctcctccggccccaggtcaccgccagcacgcgcctgcttcccgtctgcgcgagtccacgcagctccccaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccaggtctggggcactccaaggaagcagcagcccctgcccctattggggagctggcccctggcagcttcctggcggctgtggtggatgccttggagctgggccccccggttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctca

SEQ ID NO: 3290 - DNA, 2141 bp, Homo sapiens
tggaatttttggcgcgagcagctccgcgcgcgttcacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctaggccctggacaccctccttgtctcgcctgccctcctgcaggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggc

SEQ ID NO: 3291 - DNA, 3821 bp, Homo sapiens; identical to SEQ ID NO: 3008

SEQ ID NO: 3292 - DNA, 1080 bp, Homo sapiens
gcccggggctctgatgtcaccgcgcggctgcgacggcccaggagcgcgtctcggcgggagcctcaggacccacgcagccacccagcctcagcactcatctgcgcagccatggaggccctgggacctgggggcgaccgcgcctccccggcctcgtccactagcagcctggacctgtggcatctgtccatgcgcgcggactcggcctacagctctttctccgcagcctccggcggccccgagccgcgcacgcagtcgccggggacagacctccttccttacctagactgggactacgtgcgtgtggtttggggcggcccgggccccgccccgcccgacgctgccctttgcacatccccgcggccccggcccgcggttgcagcccgcagtgggccgcagccaacagaggtcccggggaccccgggaccactgaacaggcaggccaccccgctgctgtacgcgctggcggccgaggcggaggccgcggcgcaggctgccgagccgcccagcccgccggcctcgagggccgcctaccgccagcggcttcagggcgcgcagcggcgagtgctccgggagacgtcgttccagcgcaaggagctccgcatgagcctgcccgcccgtctgcggcccactgtcccagcgcggcccccggcgactcacccgcgctccgcctcgctcagccacccgggcggggagggggagccggcgcgctcccgggctcccgcgccaggaactgccggccggggtcccctcgccaaccagcagcggaagtggtgcttctcagagccaggaaagctggatcgtgtgggtcggggcggtgggccggcgcgggaatgcctgggtgaggcctgctccagctctggcctccctgggcccgagcccttggagttccagcatccggcgctggctaagtttgaagatcacgaggtcggatggctgcccgagacgcaaccccaaggctccatgaacctggactccgggtccttgaagctcggtgatgccttcaggcccgccagtcggagtcggagcgcttcaggcgaagtcttgggttcctggggaggatcaggagggaccatacccatt

SEQ ID NO: 3293 - DNA, 970 bp, Homo sapiens
gtgattagggccaacatggccgccgccgccgcttggagctgaagtgccgccgccgccgggcagccacggggaatccgcccgcatcgccgccctcgccggccgggcggccgtggggcccagagcgccggaggccagggctggggcggcaccgcgcagcggccacggggtcccgttagagcagcgcccggcggctatgccgagagcccggagcggccggaggagcagaggggccggcgggagggaggaaacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctg

SEQ ID NO: 3294 - DNA, 582 bp, Homo sapiens; identical to SEQ ID NO: 3048

SEQ ID NO: 3295 - DNA, 1415 bp, Homo sapiens
aaaggggcggcccggcccggcccggaagctacagcagcggcgcggagactgcggggcgggccatggcggcgaacctgagccggaacgggccagcgctgcaagaggcctacgtgcgggtggtcaccgagaagtccccgaccgactgacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagctt

SEQ ID NO: 3296 - DNA, 705 bp, Homo sapiens
cgcgccgaaattcaaaggaataaatagttccggcgcgggtgttgagagcggtgtggcaggtgttgtagccgctatggtgaagttcgctttgtagcggccccggctagagagttgttctgttccctgcctttgtgacccggaggagcttttggggtggttattggtggtagaaataaatatttaatcaatggagtcaatgccaacaacaccagagtacaggatctcttctgttctgttggccttaatgttaacaaccctcactttctcatcatgcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataag

SEQ ID NO: 3297 - DNA, 1557 bp, Homo sapiens
catcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactggaatctcccaacagagaaattattattttacacaatccaaaggagaacctttacaaatagatcacttggtttttgtagtccatgggattggaccagcttgtgatctccgctttcgaagcattgtacagtgtgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaaggattcgctaaatattgtaatggatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgcta

SEQ ID NO: 3298 - DNA, 2251 bp, Homo sapiens
caggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggcctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggtggtcacagtggacgtgagaactaagaaggtcgtgttcaaggatggcttcaagctggagtacagcaagctgctgctggcaccagggagcagccccaagactctgagctgcaaaggcaaagaagtggagaacgtgttcactatccggacgccagaggatgccaatcgcgtggtgaggctggcccgaggccgcaacgtggtcgtcgtgggagccggcttcctggggatggaggtggccgcttacctgacggagaaggcccactctgtgtctgtggtggagctggaggagacgcccttcaggaggttcctgggggagcgcgtgggtcgagccctcatgaagatgtttgagaacaaccgggtgaagttctacatgcagacggaggtgtctgagctgcggggccaggagggaaagctgaaggaggttgtgctgaagagcagcaaggtcgtgcgggctgacgtctgcgtggtgggcattggtgcagtgcccgccacaggcttcctgaggcaaagcggcatcggtttggattcccgaggcttcatccctgtcaacaagatgatgcagaccaatgtcccaggcgtgtttgcagctggcgatgctgtcaccttcccccttgcctggaggaacaaccgcaaagtgaacattccacattggcagatggctcatgctcaggggcgcgtggcagcccagaacatgttggcgcaggaggcggagatgagcactgtgccctacctctggaccgccatgtttggcaagagcctgcgctacgcgggctacggagaaggcttcgacgacgtcatcatccagggggatctggaggagctgaagtttgtggctttttacactaaaggcgacgaggtgatcgccgtggccagcatgaactacgatcccattgtgtccaaggtcgctgaggtgctggcctcaggccgtgccatccggaagcgggaggtggagctgtttgtgctgcacagcaagactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacacgtta

SEQ ID NO: 3299 - DNA, 617 bp, Homo sapiens
attttcctgcagtcactgctggcagatgatagagccaggatttgaaagcaggcagcctggctccagaccctgtgctcttaactcccgttttgcatcaagaacagaatcctatgaaaggatagcagcatcaaggagcattgtgtacatgcagaagtgcacagtacctggagtgaaactgcttgtgttcgatttctgataccattcataactggctgtgtgatctcaaataagaaaactgaagaaccagctgggcgcggtagctcacgcctgtaatcccagcactttgggaggctgaggcgggtggattacctgagaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtga

SEQ ID NO: 3300 - DNA, 1198 bp, Homo sapiens
ggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagttaa

SEQ ID NO: 3301 - DNA, 871 bp, Homo sapiens
ggaaacgcggcccaaactgttacgaagtggaagaggctggatagctcttcataattaatcaggaatgggaggtttgagcaggtttacttgatgagggaaacattatagcctcgccaattcattcattatttcaacaattacttattgaacacctgctacgtggcagacagccaaggaggcgggtttggtgcggccactccaaggccaaagcgagaaaatcttactgcgcacgcgcaatagacagccgatggagccaccgatggagccgtccggaggggagcaagagcccggagccgtcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgggtccgcagatcccgcgggccgcattggcccggctgctgcgggatgccgaggggctgcaggagctggcactggcgccgtgtcacgaatggctgtcagacgaggacctggtgccggtgctggcgcggaatccgcagctgcggagtgtggcgttgggcggctgcgggcaactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagaggcgcggcgctggtctccgcagcctctctctggccgtcaacgccaacgtgggggac

SEQ ID NO: 3302 - DNA, 2514 bp, Homo sapiens
gttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtcgttaatgaaaaaggatggaactacattcttgagaaatatgatgggcatcttccaatagaaataaaagctgttcctgaaggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcatttggttaacttcaaaggaacagatacagtagcaggacttgctctaaataaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcaatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttaacaagagatctcttgaattgttccttcaagtgtagctatgttgtaactaatggccttgggattaacgtcttcaaggacccggttgctgatcccaacaaaaggtccaaaaagggccgattatctttacataggacgccagcagggaattttgttacactggaagaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtgtgtgtgtgcatgcacacacacacacacctttgtgtatgtaatacataatgtttattgtacagatgtgtggggtttgtgttttatgacacattacagccaaattatttgttggtttatggacatactgccctttcattttttttcttttccagtgtttaggtgatctcaaattaggaaatgcatttaactatgtaaaagattagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgcacaatttgaaaattatgtcgggacataccctatagaattactaaccttactgccccttgtagaatatgtattaatcattctacattaaagaaaataatggttcttactggaatgtctaggcactgtacagttattatatgtcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggcatgacttaaatgaattactggagtgggtagtgagtgtacttatcttaaatgtttcaattctgttatattttttattaagttttttaaaaattaaattgatattaaattgtaaaaaaaaaaaaaaaa

SEQ ID NO: 3303 - DNA, 541 bp, Homo sapiens
tgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgtactgtttgaagtcatccttttgttgttaatttaagaataaaattctcagcatttga

SEQ ID NO: 3304 - DNA, 2445 bp, Homo sapiens
atgaggctcctggatgggaaacagacttccaggtactcagagaatgcctgcgagaagaagattttctctatctacggacactacccggtggtccgggccgctctgcgaaggaagggctgggtagagaagaagttccactttttgcccaaggtcattccggatgtcgaggatgaaggcgcccgggtcaatgatgatacatgtgccaaagtcaaagaaaatcaagaaatggctttggagaaaacagacaacatccacgacgtgatgtctaggttggtaaaaaatgagatgccgtacctcctctggaccatcaagagggacatcattgactatcacagcctgacctacgaccagatgctgaaccactacgcaaagacagcctccttcaccaccaagatcgggctgtgcgtgaacatgcggagcctgccctggtacgtcccggccaaccccgactccttcttcccacgctgctacagcctctgcaccgagagtgagcagcaggagttcctggaagacttccggcgcaccatggcatccagcatcctcaagtgggtggtcagccaccagagctgcagcaggagcagcagaagcaagcccagggaccagagggaggaggccgggagcagcgacctgagcagcaggcaagatgctgaaaatgctgaggcaaagctcaggggcctcccggggcagcttgtggacatcgcgtgcaaggtgtgccaggcctacctggggcagctggagcatgaggacatcgacacgtcagcagatgccgtggaggacctcactgaggccgagtgggaggacctgacccagcagtactactccctcgttcatggcgatgctttcatctccaattcaagaaattacttttcgcagtgccaggctctgctgaatagaatcacgtctgtgaaccctcagacggacattgacgggctccggaacatctggattataaagcccgcggccaagtcccggggccgagacatagtgtgcatggaccgtgtggaggagatcctggagctggcagctgcagaccaccctctttccagggacaacaagtgggtggtccagaagtacatcgagacgccgctgctcatctgtgacaccaagttcgacatcagacagtggttcctcgtcacggactggaaccccctgaccatctggttctacaaggagagttacttgcggttctcaactcagcgcttctccctggacaagctggacagcgccatccacctgtgcaacaacgccgtccagaagtacctgaagaatgatgtgggccgcagccccctgctgcccgcacacaacatgtggaccagcaccaggttccaggagtacctgcagcgccagggccgtggcgccgtgtggggcagcgtcatctacccgtccatgaagaaggccatcgcccacgccatgaaggtggcccaggaccacgtggagcctcgcaagaacagctttgagctctacggggctgacttcgtccttgggagggacttcaggccctggctgatcgagatcaattccagccccaccatgcacccgtccacgccggtcacggcccagctgtgtgcacaggtgcaggaggacaccatcaaggtggccgtggaccgcagctgtgacatcggcaacttcgagctcctgtggaggcagccggtggttgagccgcccccattcagcgggtccgacctctgcgtggcgggcgtcagtgtgaggagagccaggaggcaggtgctgcccgtctgcaacctcaaggcctcggcctcgctgttggacgcgcagccgctgaaggcacggggcccctcggccatgccagaccctgcccagggacccccatcaccagctctccagcgggacttgggactgaaggaagagaaggggctccccctggccttgctggcacccttaaggggggcagccgagagcggtggagccgcacagcccacccgcaccaaagctgctgggaaggtggagctcccggcctgcccctgtcgccacgtggacagtcaggccccaaacaccggtgtccccgtagcccagcccgccaaaagctgggatccaaaccagctaaatgcgcacccgctggagcctgtgctgcggggcctgaagacagcagagggcgcgctgcgtccgccgcccggaggaaaaggagagggcacggtctgcagccgcctgccacaccacgggcaccacgtggccgcctgccagaccacgggcaccacgtgggatggtgggcctggggtgtgcttcctccggcagctcctggcatcagaactgcccatgggccctgggctgccgagggacccccgagcgccgccctgcctcgtgtgccgcgggctgctgccacccgccgggccctgcaagcgctgccgctcgttctgcgccgcggtcctgcagggcgcgtccttcgtgcggctcggcgggcggagctgcagcccgcggaccccgtga

SEQ ID NO: 3305 - DNA, 550 bp, Homo sapiens
aagagccctgggctgggtggggcagggcggaagggccctggccttgttgggtggaggtgaagagttaatggctccgcgcgcaggcactgccctctgaactggaacaaaatgcaacttccggttggagtcactcggccaggcgccggcgacctgaggggagagggaacgcagctgaaagcgtgaactacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaa

SEQ ID NO: 3306 - DNA, 1145 bp, Homo sapiens
aagatggcgccggtgggggtggagaagaagctgctgctaggtcccaacgggcccgcggtggcggccgccggcgacctgaccagtgaggaggaggaaggccagagcctatggtcctccattctgagcgaagtgtccacccgcgccaggtccaagctgccgtccggcaagaacatcctggtcttcgatcacacgcgctgcaacgtgtggattctggatggagacttgtaccacaaaggcctgctgaaatttgcagtttctgctgaatccttgccagagaccctcgtcatttttgttgcagacatgtctagaccttggactgtgatggaatctctgcagaaatgggctagtgttttacgtgagcacattgataaaatgaaaattccaccagaaaaaatgagggagctggaacggaagtttgtgaaagattttcaagactatatggaacctgaagaaggttgtcaaggttccccacagagaagaggccctctgacctcaggctccgatgaagaaaatgttgccctgcctctgggtgacaatgtgctgactcataacctggggatcccggtgttggtggtgtgcacaaagtgtgatgcggtgagtgtcctggagaaggagcacgattacagggatgagcatttggactttatccagtcacacctgcggaggttctgccttcagtatggagctgccttgatttacacatcagtgaaagaagagaaaaacctcgacttgttgtataagtatattgttcataaaacatacggtttccacttcaccacacctgccttagttgtggaaaaggatgccgtttttatgtgagttattttgagctgatgctttgaaactcttctttttaaagtacatttgctttttacattttaccccttcaaggaaggtgccttctgtctgtgtcttctacagccagctctctcactgcaccttctctctgttcctttccggattatgaggcatctgcctgagggaagtgggtggtgtggtcaggggtgctgcctttcttcctcgagagcaagttgccaaaacctaagccagccatttttggcactcactgtcaactctggtaaaatactggctggggagggaatatagggaattgtgcttgggggatcctgaatgtcttctattaa

SEQ ID NO: 3307 - DNA, 724 bp, Homo sapiens
tgggagtgtggctctgtgcgtgcgtgatgagtgccagatagattcgcggaagaaattgggtggctgtgtgctggcgtgtgattgtgcgcgccggacatggccatgtgagttggttcattcttggtccggtgccccttctgttgggtaaaacttggatctggcccgagaatacttcagagagtcagagttgtgccagaagtctcttaatggcagatagaatgcaaatagttgtgattctctcagaattttttaataccacatggcaggaggcaaattgtgcaaattgtttaacaaacaacagtgaagaattatcaaacagcacagtatatttccttaatctatttaatcacaccctgacctgctttgaacataaccttcaggggaatgcacatagtcttttacagacaaaaaattattcagaagtatgcaaaaactgccgtgaagcatacaaaactctgagtagtctgtacagtgaaatgcaaaaaatgaatgaacttgagaataaggctgaacctggaacacatttatgcattgatgtggaagatgcaatgaacatcactcgaaaactatggagtcgaactttcaactgttcagtcccttgcagtgacacagtgcctgtaattgctgtttctgtgttcattctctttctacctgttgtcttctaccttagtagctttcttcactcagagcaaaagaaacgcaaactcattctgcccaaacgtct

SEQ ID NO: 3308 - DNA, 685 bp, Homo sapiens
gtttattcattgtactgatgattctccagatccatgtatagaatatgagctcgttctccgaaaatggtgtgaattgattcctggggctgagtttcgatgttttgtcaaggaaaacaagcttattggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcagaagagaaatcagcaggaggacgactgatgagcgtactggaactggagaagaggaggccccgccccaccgctccgggagctgctcatcagccgcaacttcctgccgaccctgatgcgggtgggccgagcagtgtggacatcagccactttttatattcatgtacattcacctggggaaaaaaacggagggactttgctacttgtaaaaataacataataaatagatcttaaacataggaaaaccatactgttctgataataaaatgctttctatgaaata

SEQ ID NO: 3309 - DNA, 976 bp, Homo sapiens
atatccaaggggaggcgtccaggagggctgctggagagccagaggctggcagcgactatgtgaagttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcactcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccaccagtacgtcgctgccccgccctcgggactccatccgcagctgtgccctcagcatggaccagatcccagacctgcactcacccatgtcgcccatctccgagagccctagctcccctgcctacagcactgtaacccgtgtccatgccgcccctgcagccccttctgccacagcattgcctgcctcccctgtcgcccgccgttccagtgagccccagctgtgtcccggaagtgccccaaagacccatggggagtcagacaagggcccccacaccagcccctcccacacccttggcaaggcctccccgtcaccatcactcagcagctacagtga

SEQ ID NO: 3310 - DNA, 501 bp, Homo sapiens
gcaaacggggccggaaagcgtggcagcgcaggcgcaagcgcagagagcggaggcggtggtggtggcggccgctggccagttgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggagga

SEQ ID NO: 3311 - DNA, 1780 bp, Homo sapiens
gctgctggtgctcctcgcctcttggggcctggggcagtgagggggccggcgggcgtgggccgagtggccgcgggcgccatggagggggtgctgtacaagtggaccaactatctgagcggttggcagcctcgatggttccttctctgtgggggaatattgtcctattatgattctcctgaagatgcctggaaaggttgcaaagggagcatacaaatggcagtctgtgaaattcaagttcattctgtagataatacacgcatggacctgataatccctggggaacagtatttctacctgaaggccagaagtgtggctgaaagacagcggtggctggtggccctgggatcagccaaggcttgcctgactgacagtaggacccagaaggagaaagagtttgctgaaaacactgaaaacttgaaaaccaaaatgtcagaactaagactctactgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagatcgcaaatgcagccttcacctctgagctgctctaccgcactccaccaggatcacctcagctggccatgctcaagtccagcaagatgaaacatcctattataccaattcataattcattggaaaggcaaatggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataacagtccaaggtgaaataaggaaggaagatggaatggaaaacctgaaaaatcatgacaataacttgactcagtctggatcagactcaagttgctctccggaatgcctctgggaggaaggcaaagaagttatcccaactttctttagtaccatgaacacaagctttagtgacattgaacttctggaagacagtggcattcccacagaagcattcttggcatcatgttatgctgtggttccagtattagacaaacttggccctacagtgtttgctcctgttaagatggatcttgttggaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggagaaggatatccagacagccctaaataatgcatatggtaaaacattgcggcaacaccatggctgggtagttcgaggggtttttgcgttagctttaagggcagctccatcctatgaagattttgtggccgcgttaaccgtaaaggaaggtgaccaccagaaagaagctttcagtattgggatgcagagggacctcagcctttacctccctgccatggagaagcagctggccatactggacactttatatgaggtccacgggctggaatctgatgaggtggtatgatggctgctgggcagcacctcctaacttcagggaataagtgctaaagtgttttgttgccctacttaatttccagcaacagcctcaaccctctccaaccccttcacctggggggatggacaggaggtggcaaaacccagtgctt

SEQ ID NO: 3312 - DNA, 2614 bp, Homo sapiens
ggaggccgctgggacgcggttcagctcattccctgaggccggcccgcgtcccgtcaggcgccgcgcggggttagcgcggggtcagcggaggtcagcgggggtcagcagcagcggctccgagggcgcggcggacgcaggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgagattgcctgacccaggcctgctcggccctcacagggtgagtgggggctgcacctgcgggggctttggggaccgagaccccccgcctcacacccgctgtcttcacagcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccgaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctcctggagggtggaggctcctggctgttggacacggtgatggtgttactgggctgctcaggggctggtgggcaggtgaggggctccccaggtgggcctggagagtccaggcactcccttcctgcggatgtgggaaggacatggggtcctgggaggagctgctgggaaggggcatgagtcagggtgggggtggcgcagcagctgcggggctgtgactcacaggagtcgggccctggaagtccccgcgtcctctccaggggaccctgtgtgtgttctgcaggttggttcccaggacctgggggggacctccagccccgggaacctggccgtgctggggaggcgagtggctggtgcagccccccggttgctctgggtgcatcgggaggcttcagagcctgccccagagagggagaagcttcacttcccggaaagcatgggaggcctggaggaggtctttggcaggtcccctctcgggaaatcccctgtgagttgggagtgggaggaattcataagtggggggttagtgtgggccccggcgactagggctggcctgagccccatcctgttcttccagcaatgataccctcccaggccctgaccctcgctgagcttcaggggcccctgccacgtgccacagccactgggggcagaggtggcactccccactgatcctcccagggagggtctgtctgaggtaggggaagccccgggcagcagttctgatggcaggcagcctgagggatctgggcacagcgggcggctcaggtgtccccggctgccctcccagtagctgtgcaactacaaccagttttatgaaaaagctttataaaaataagctttaagaaacctc

SEQ ID NO: 3313 - DNA, 1067 bp, Homo sapiens
agtacaatgcggccgcggggagcgcgggcccgcgggggaggggagcgccgccgcgccgggctcggcccctccccctctctgcgctctcttcgggatacacgtgggcttcgggcctgggccgcgcagtttttctttggctttctcgaatcatcgaggagactggcaaaattagtaatgtctttagactgcgtcactagcgccaatcgaattcgtagttgattgttctttgaattcacatttgagtcctcggttaaaacctcagttaaaaagcaggataaagtcgagctgctttggttctcggaacggaaaagcgtttttttgttgtttagaggcttggcctttatggggctcgtgtgtgttttaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagcc

SEQ ID NO: 3314 - DNA, 2920 bp, Homo sapiens
agctcctctgacaaggagtccatcctgaccatcctcaaggtcctcggagatctgctttctgttggcacagaccggagaattcactacatgatcagcaagggtggcagtgaagctcttctgcagaccctggtagacacagcgaggacagctcctccagactatgacatcctcctgcctctcttccggctgctggccaaagttggcctaagagataaaaagattggacggaaggccctagaattggaagcacttgatgtgacattgattctggccaggaagaacctatcccatggccagaatctcctccactgtctctgggctctgcgtgtgtttgcctccagtgtctccatgggagccatgctgggaattaatggagccatggaactgcttttcaaggttattactccttacacccgaaagcgcacccaagcaatcagggcagccactgaagttttggcagcattgctgaaatccaagtcgaacggccgcagagcagtgaaccgaggctacgtcaccagcctgctcgggctgcaccaggactggcacagccatgacacagccaacgcctacgtgcagatccgacggggcttgctgctctgcctcaggcacattgctgccctccggtccggcagggaggccttcctggcagcacagggcatggagatcctcttcagcaccacacagaactgcctggatgacaagagcatggagcccgtcatctctgtggtgcttcagatcctgaggcagtgctaccctacgagtccacttcccttggtcacagccagcagtgcctatgccttcccggtccccgggtgcatcaccactgaacctccacatgatctacctgaagaggattttgaagatgatggcgatgatgaagtggacaaagactctgatactgaagatgggaaagtggaagatgatgacttggaaacagacgtgaacaagctgagttccaaacctggtcttgaccgacctgaagaggaactgatgcaatatgaggtgatgtgtcttgagctctcctatagctttgaggaactgcagtccaaacttggagatgatttgaactctgaaaagactcagtatgccaatcaccaccacattccagccgctgcctcctcaaaacagcattgctacagcaaggaccaaagctcctgtgggcaagaaagagaatatgctgtccagacttcccttctgtgcagggtgaagacgggaaggtccactgtgcatctaggctccaaaaaaaatcctggagtgaacctgtaccaaaatgtgcaatccaatagtctcaggagagattcttctgaaagtgaaatccctgacattcaggcttccccgaaagcagatgcctgggacgtagatgcaattttctgcccaaggatgagtgcctccttttctaattccactaggactagagaagttgtcaaagtaatagataagcttctgcagacacatctgaagcgtgtccctttccacgatccctatctttatatggccaaagccagaagaaccagctctgtggtggacttcaagatgatggcatttcctgatgtctggggacactgtccccctcccaccacccagcctatgttggaacgaaaatgtggagtccaaaggatcaggatatttgaggatattcggaggctcatccagccaagtgatgttataaataaagttgtcttcagtttagatgagccttggcctttgcaagacaatgcttccaattgtttacggttcttctccaaatttgagtcaggaaatcttcgcaaagccatccaagtgcgtgagttcgagtatgacttgctggtcaacgcagatgtgaatagcacccagcaccagcagtggttctatttcaaagtgagcggtatgcaggcggccatcccttaccacttcaacatcatcaactgtgagaagcccaacagccagtttaattatgggatgcagcccaccctatattctgtgaaggaggctcttcttggcaaacccacctggataaggacaggccatgaaatatgttattacaaaaatcattatcgccagagtacagctgttgcaggcggagcatctgggaagtgctactataccctcacctttgctgtcaccttcccacacagtgaggatgtctgctacctggcctaccactatccctatacctacacagccctcatgactcatcttgacatcctggaaaagagtgtcaacctcaaagaggtctacttccggcaagatgttctctgccagacgctgggagggaatccgtgtcccttggtgaccatcacggccatgcctgagtccaacagtgatgagcatctagagcagttccgacatcgtccatatcaggtgatcactgctcgagttcatccaggagagagcaatgccagttgggtgatgaagggtaccttggagttcctggtcagcagtgaccctgtggctaggctcttgagggaaaacttcatcttcaagatcatacccatgctcaacccagatggtgtcatcaacggcaaccacagatgctcactgagcggggaagatttgaacagacaatggctttctcccagtgctcatctgcagccaaccatttaccatgccaaaggcctcctctaccacctgagcagcattggccgaagtcccgtggtgagtcacttccttctggttttctgtgacttccatggccactcccaaaagaagaatgtgttcctttatggctgtagcatcaaggaaaccttgtggcaagcagcatgcactgtgggcacatctactatcctagaggaggtcaactacaggactcttcccaaaatccttgataagctagcaccagcattcacaatgagcagctgcagctttctcgtggagaaatctcgagcttccacggcccgggtggtggtgtggagagagatgggggtgtccagaagctacacca

SEQ ID NO: 3315 - DNA, 7829 bp, Homo sapiens
ctccagcatcaccttctctgtgaaggtagaaggacgcccggtgcccaccgtgcactggctcagggaggaggctgagagaggcgtgctgtggattggccctgacacaccgggctacaccgtggccagctctgcgcagcagcacagcctggtcctgctggacgtgggccggcagcaccagggcacctacacatgcattgccagcaacgctgccggccaggccctctgctccgccagcctgcacgtctcgggcctgcctaaggtggaggagcaggagaaagtgaaggaagcgctgatttccactttcctgcaggggaccacacaagccatctcagcacaggggttggaaactgcgagttttgctgaccttggtgggcagaggaaagaagagcctctggctgccaaggaggccctcggccacctgtccctcgctgaggtgggcacagaggagttcctgcagaaactgacctcccagatcactgagatggtatcggccaagatcacgcaggccaagctgcaggtgcccggaggtgacagtgatgaggactccaagacaccatctgcatccccccgccatggccgatcacggccatcctccagcatccaggagtcttcctcagagtcagaggacggcgatgcccgaggcgagatctttgacatctacgtggtcaccgctgactacctgcccctaggggctgagcaggatgccatcacgctgcgggaaggccagtatgtggaggtcctggatgcagcccacccactgcgctggcttgtccgcaccaagcccaccaagtccagcccctcacggcagggctgggtgtcaccagcctacctggacaggaggctcaagctgtcacctgagtggggggccgctgaggcccctgagttccctggggaggctgtgtctgaagacgaatacaaggcaaggctgagctctgtgatccaggagctgctgagttctgagcaggccttcgtggaggagctgcagttcctgcagagccaccacctgcagcacctggagcgctgcccccacgtgcccatagctgtggccggccagaaggcagtcatcttccgcaatgtgcgggacatcggccgcttccacagcagcagcttcctgcaggagttgcagcagtgcgacacggacgacgacgtggccatgtgcttcatcaagaaccaggcggcctttgagcagtacctggagttcctggtggggcgtgtgcaggctgagtcggtggtcgtcagcacggccatccaggagttctacaagaaatacgcggaggaggccctgttggcaggggacccctctcagcccccgccaccacctctgcagcactacctggagcagccagtggagcgggtgcagcgctaccaggccttgctgaaggagctgatccgcaacaaggcgcggaacagacagaactgcgcgctgctggagcaggcctatgccgtggtgtctgccctgccacagcgcgctgagaacaagctgcacgtgtccctcatggagaactacccaggcaccctgcaggccctgggcgagcccatccgccagggccacttcatcgtgtgggagggtgcaccgggggcccgcatgccctggaagggccacaaccgtcacgtgttcctcttccgcaaccacctggtaatctgcaagccccggcgagactcccgcaccgataccgtcagctacgtgttccggaacatgatgaagctgagcagcatcgacctgaacgaccaggtggagggggatgaccgcgccttcgaggtgtggcaggagcgggaggactcggtgcgcaagtacctgctgcaggcacggacagccattatcaagagctcgtgggtgaaggagatctgtggcatccagcagcgtctggccctgcctgtgtggcggcccccggactttgaagaggagctggccgactgcacagccgagctgggtgagacagtcaagctggcctgccgcgtgacgggcacacccaagcctgtcatcagctggtacaaagatgggaaagcagtgcaggtggacccccaccacatcctcattgaagaccctgatggctcgtgtgcactcatcctggacagcctgaccggtgtggactctggccagtacatgtgcttcgcggccagcgccgctggcaactgcagtaccctgggcaagatcctggtgcaagtcccaccacggttcgtgaacaaggtccgggcctcaccctttgtggagggagaggacgcccagttcacctgcaccatcgaaggcgccccgtacccgcagatcaggtggtacaaggacggggccctgctgaccactggcaacaagttccagacactgagtgagcctcgcagcggcctgctagtgctggtgatccgggcggccagcaaggaggacctggggctctacgagtgtgagctggtgaaccggctgggctccgcgcgggctagtgcggagctgcgcattcagagccccatgctgcaggcccaggagcagtgtcacagggagcagctcgtggctgcagtggaagacaccaccctggagcgagcggaccaggaggtcacatctgtcctgaagagactgctgggccccaaggcgccaggcccctccacaggggacctcactggccctggcccctgccccaggggggcacccgcactccaggaaaccggctcccagcccccagtcaccggaacttcggaggcacctgccgtgcccccgagggtgccacagcccctcctccacgaaggcccagagcaggagccggaggccattgccagagcccaggaatggactgtgcccattcggatggagggtgcagcctggcccggggcaggcacaggggagctgctctgggacgtccacagccacgtggtcagagagaccacacagaggacctacacataccaggccatcgacacgcacaccgcacggcccccatccatgcaggtaaccatcgaggatgtgcaggcacagacaggcggaacggcccaattcgaggctatcattgagggcgacccacagccctcggtgacctggtacaaggacagcgtccagctggtggacagcacccggcttagccagcagcaagaaggcaccacatactccctggtgctgaggcatgtggcctcgaaggatgccggcgtttacacctgcctggcccaaaacactggtggccaggtgctctgcaaggcagagctgctggtgcttgggggggacaatgagccggactcagagaagcaaagccaccggaggaagctgcactccttctatgaggtcaaggaggagattggaaggggcgtgtttggcttcgtaaaaagagtgcagcacaaaggaaacaagatcttgtgcgctgccaagttcatccccctacggagcagaactcgggcccaggcatacagggagcgagacatcctggccgcgctgagccacccgctggtcacggggctgctggaccagtttgagacccgcaagaccctcatcctcatcctggagctgtgctcatccgaggagctgctggaccgcctgtacaggaagggcgtggtgacggaggccgaggtcaaggtctacatccagcagctggtggaggggctgcactacctgcacagccatggcgttctccacctggacataaagccctctaacatcctgatggtgcatcctgcccgggaagacattaaaatctgcgactttggctttgcccagaacatcaccccagcagagctgcagttcagccagtacggctcccctgagttcgtctcccccgagatcatccagcagaaccctgtgagcgaagcctccgacatttgggccatgggtgtcatctcctacctcagcctgacctgctcatccccatttgccggcgagagtgaccgtgccaccctcctgaacgtcctggaggggcgcgtgtcatggagcagccccatggctgcccacctcagcgaagacgccaaagacttcatcaaggctacgctgcagagagcccctcaggcccggcctagtgcggcccagtgcctctcccacccctggttcctgaaatccatgcctgcggaggaggcccacttcatcaacaccaagcagctcaagttcctcctggcccgaagtcgctggcagcgttccctgatgagctacaagtccatcctggtgatgcgctccatccctgagctgctgcggggcccacccgacagcccctccctcggcgtagcccggcacctctgcagggacactggtggctcctccagttcctcctcctcctctgacaacgagctcgccccatttgcccgggctaagtcactgccaccctccccggtgacacactcaccactgctgcacccccggggcttcctgcggccctcggccagcctgcctgaggaagccgaggccagtgagcgctccaccgaggccccagctccgcctgcatctcccgagggtgccgggccaccggccgcccagggctgcgtgccccggcacagcgtcatccgcagcctgttctaccaccaggcgggtgagagccctgagcacggggccctggccccggggagcaggcggcacccggcccggcggcggcacctgctgaagggcgggtacattgcgggggcgctgccaggcctgcgcgagccactgatggagcaccgcgtgctggaggaggaggccgccagggaggagcaggccaccctcctggccaaagccccctcattcgagactgccctccggctgcctgcctctggcacccacttggcccctggccacagccactccctggaacatgactctccgagcaccccccgcccctcctcggaggcctgcggtgaggcacagcgactgccttcagccccctccgggggggcccctatcagggacatggggcaccctcagggctccaagcagcttccatccactggtggccacccaggcactgctcagccagagaggccatccccggacagcccttgggggcagccagcccctttctgccaccccaagcagggttctgccccccaggagggctgcagcccccacccagcagttgccccatgccctcctggctccttccctccaggatcttgcaaagaggcccccttagtaccctcaagccccttcttgggacagccccaggcaccccctgcccctgccaaagcaagccccccattggactctaagatggggcctggagacatctctcttcctgggaggccaaaacccggcccctgcagttccccagggtcagcctcccaggcgagctcttcccaagtgagctccctcagggtgggctcctcccaggtgggcacagagcctggcccctccctggatgcggagggctggacccaggaggctgaggatctgtccgactccacacccaccttgcagcggcctcaggaacaggcgaccatgcgcaagttctccctgggtggtcgcgggggctacgcaggcgtggctggctatggcacctttgcctttggtggagatgcagggggcatgctggggcaggggcccatgtgggccaggatagcctgggctgtgtcccagtcagaggaggaggagcaggaggaggccagggctgagtcccagtcggaggagcagcaggaggccagggctgagagcccactgccccaggtcagtgcaaggcctgtgcctgaggtcggcagggctcccaccaggagctctccagagcccaccccatgggaggacatcgggcaggtctccctggtgcagatccgggacctgtcaggtgatgcggaggcggccgacacaatatccctggacatttccgaggtggaccccgcctacctcaacctctcagacctgtacgatatcaagtacctcccattcgagtttatgatcttcaggaaagtccccaagtccgctcagccagagccgccctcccccatggctgaggaggagctggccgagttcccggagcccacgtggccctggccaggtgaactgggcccccacgcaggcctggagatcacagaggagtcagaggatgtggacgcgctgctggcagaggctgccgtgggcaggaagcgcaagtggtcctcgccgtcacgcagcctcttccacttccctgggaggcacctgccgctggatgagcctgcagagctggggctgcgtgagagagtgaaggcctccgtggagcacatctcccggatcctgaagggcaggccggaaggtctggagaaggaggggccccccaggaagaagccaggccttgcttccttccggctctcaggtctgaagagctgggaccgagcgccgacattcctaagggagctctcagatgagactgtggtcctgggccagtcagtgacactggcctgccaggtgtcagcccagccagctgcccaggccacctggagcaaagacggagcccccctggagagcagcagccgtgtcctcatctctgccaccctcaagaacttccagcttctgaccatcctggtggtggtggctgaggacctgggtgtgtacacctgcagcgtgagcaatgcgctggggacagtgaccaccacgggcgtcctccggaaggcagagcgcccctcatcttcgccatgcccggatatcggggaggtgtacgcggatggggtgctgctggtctggaagcccgtggaatcctacggccctgtgacctacattgtgcagtgcagcctagaaggcggcagctggaccacactggcctccgacatctttgactgctgctacctgaccagcaagctctcccggggtggcacctacaccttccgcacggcatgtgtcagcaaggcaggaatgggtccctacagcagcccctcggagcaagtcctcctgggagggcccagccacctggcctctgaggaggagagccaggggcggtcagcccaacccctgcccagcacaaagaccttcgcattccagacacagatccagaggggccgcttcagcgtggtgcggcaatgctgggagaaggccagcgggcgggcgctggccgccaagatcatcccctaccaccccaaggacaagacagcagtgctgcgcgaatacgaggccctcaagggcctgcgccacccgcacctggcccagctgcacgcagcctacctcagcccccggcacctggtgctcatcttggagctgtgctctgggcccgagctgctcccctgcctggccgagagggcctcctactcagaatccgaggtgaaggactacctgtggcagatgttgagtgccacccagtacctgcacaaccagcacatcctgcacctggacctgaggtccgagaacatgatcatcaccgaatacaacctgctcaaggtcgtggacctgggcaatgcacagagcctcagccaggagaaggtgctgccctcagacaagttcaaggactacctagagaccatggagctcctggagggccagggggctgttccacagacagacatctgggccatcggtgtgacagccttcatcatgctgagcgccgagtacccggtgagcagcgagggtgcacgcgacctgcagagaggactgcgcaaggggctggtccggctgagccgctgctacgcggggctgtccgggggcgccgtggccttcctgcgcagcactctgtgcgcccagccctggggccggccctgcgcgtccagctgcctgcagtgcccgtggctaacagaggagggcccggcctgttcgcggcccgcgcccgtgaccttccctaccgcgcggctgcgcgtcttcgtgcgcaatcgcgagaagagacgcgcgctgctgtacaagaggcacaacctggcccaggtgcgctgagggtcgccccggccacacccttggtctccccgctgggggtcgctgcagacgcgccaataaaaacgcacagccgggcgag

SEQ ID NO: 3316 - DNA, 2421 bp, Homo sapiens
actagccggttactagctgcgcttttgttccacttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgtaccagtgaaagtcatctcagctgcctgaagcaggacattctaaatgaaaagactgaattggaagcaacacttaaggaagcggagttggtaactcattctgtagaattgcttttgccactatttaaggacaccattgaaaagattaattttgaaaatgcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtgatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagagtatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagaacaaaatcaacttgtttgcaaaatgaacagtacaaatggctaactacaataaccagtgtagagaagtccttaaatgacctgacggagctgaaaaccatggtatgagaactacatgacaaatgcacaagcttcagtagccgattcattcaactggaagaaaggatatcagtgactgaagatcaaatgaatgaaatgaacaatcctcccctcatccatggtttcattttctatggttccagttactcatggtcaaccatggtcagaaaacaggacaaactgagagtaaaagatgcaggaataaaacacagaaatcaaaataaagggtttactgctgaaaaatccgcttgaacaagcctgttaatgtgatcttcctg

SEQ ID NO: 3317 - DNA, 1134 bp, Homo sapiens
gggagaggcgggctcgggcccagcgccgcccgcgcgaagctccctggtgttgtgcgcccttccccgcgcgcggcccctcctgctgggctggggtctgtggctgacgtccgcttttcccggaacggcaaagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcc

SEQ ID NO: 3318 - DNA, 2796 bp, Homo sapiens
cgctttggggttctgtgtgcagcgagcatggtgtccttggcaccagggtttcggcagaggagcctagcgtgggcctacttggactcctccgcgtggggcagctcgggacacccgggcctgcaggagagcggggttctaggctggccccggctctgcagtgcagccgggtgcctgccactcgcggggctctgtcgcagtactcgtgcctggcgcctcccctcagccacagagaccgcagtagctccaaccatcgcacccctaactgggccacgagttctctgattgccagacctgttgtctttgccactcactgttctgagtaattggagagtcgtgtattcactacacgccaaccagagtggtcctgtaaaagcgtaagcctagtgtagatacgcttctgcttaaaactcttgagtggctcccagtgcttttagaacaaaatccaaacgcctttccgaagtcgacaaggcccagcttgattgagcagaagatgtgataggagatgaggagcggggggcttctgcaaaagtgcttcggtcgctcaggcttttggcacattttgcttatgcaacctagttctttctaccttagggccttttcttgggaaagttgggagtctcactctgctgcctaggctgagtgcagtggtgtgatcgaggcgcactgcagccttgacctcctgggctcaagcgatcctcacctcggcctaccgagtagctgggactacaggcacgcgccactacactcggatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtcatcttatgcagatatgctacatgacaaagacagagttttcaagcctatggctgatgctgctgtgaagattgtggagaaaaatggctttagtgataagattaaggttatcaacaagcattccaccgaggtgactgtaggtccagagggtgacatgccatgccgtgccaacatcctggtcacagagttgtttgacacagagctgatcggggagggggcgctgccctcctatgagcacgcacacaggcatctcgtggaggaaaattgtgaggccgtgccccacagagccaccgtctatgcacagctggtggagtccgggaggatgtggtcgtggaacaagctatttcccatccacgtgcagaccagcctcggagagcaggtcatcgtccctcccgttgacgtggagagctgccctggcgcaccctctgtctgtgacattcagctgaaccaggtgtcaccagccgactttacagtcctcagcgatgtgctgcccatgttcagcatagacttcagcaagcaagtcagtagctcagcagcctgccatagcaggcggtttgaacctctgacatctggccgagctcaggtggttctctcgtggtgggacattgaaatggaccctgaggggaagatcaagtgcaccatggcccccttctgggcacactcagacccagaggagatgcagtggcgggaccactggatgcagtgtgtgtacttcctgccacaagaggagcctgtggtgcagggctcagcgctctatctggtagcccaccacgatgactactgcgtatggtacagcctgcagaggaccagccctgaaaagaatgagagagtccgccagatgcgccccgtgtgtgactgccaggctcacctgctctggaaccggcctcggtttggagagatcaatgaccaggacagaactgatcgatacgtccaggctctgaggaccgtgctgaagccagacagcgtgtgcctgtgtgtcagcgatggcagcctgctctccgtgctggcccatcacctgggggtggagcaggtgtttacagtcgagagttcagcagcttctcacaaactgttgagaaaaatcttcaaggctaaccacttggaagataaaattaacatcatagagaaacggccggaattattaacaaatgaggacctacagggcagaaaggtctctctcctcctgggcgagccgttcttcactaccagcctgctgccgtggcacaacctctacttctggtacgtgcggaccgctgtggaccagcacctggggccaggtgccatggtgatgccccaggcagcctcgctgcacgctgtggttgtggagttcagggacctgtggcggatccggagcccctgtggtgactgcgaaggcttcgacgtgcacatcatggacgacatgattaagcgtgccctggacttcagggagagcagggaagctgagccccacccgctgtgggagtacccatgccgcagcctctccgagccctggcagatcctgacctttgacttccagcagccggtgcccctgcagcccctgtgtgccgagggcaccgtggagctcagaaggcccgggcagagccacgcagcggtgctatggatggagtaccacctgaccccggagtgcacgctcagcactggcctcctggagcctgcagaccccgaggggggctgctgctggaacccccactgcaagcaggccgtctacttcttcagccctgccccagatcccagagcactgctgggtggcccacggactgtcagctatgcagtggagtttcaccccgacacaggcgacatcatcatggagttcaggcatgcagataccccagactgaccactcttgagcaataaagtggcctgagggctggg

SEQ ID NO: 3319 - DNA, 602 bp, Homo sapiens
gttaaaaggggactgacaggatgaaggcagtacagaatgctgggctgagagcaggactgagatcctagaggcagaatcccagtctacccgtactctctgggaggaagtgatgagaacttgcagcagggtggtggtagtgaaagagaagaatgaaagacaaggaagcatcagtggaacttgatgtgtggctggataccagaaatgcagaggaagttagtcaaaggttcccgtcctgatgactggagatcatggtatcactgactgagctctaggggttgtgaaatagagctcattaggcagaggatggttgtcaagttattaagcaacaaaagatcacaagcagttggaatactaatgtctagccttcatttagatatgaaagacatacaacatgctgttgtgaacttggataattctgtggttgacctggagacccttcaagctctctatgagaatagagcacagtcagacgaactcgaaaaaatagaaaagcatggccgatcttccaaagacaaggaaaatgccaagtctctggacaaacctgaacagttcctttatgaactgtcactaatccccaacttttcagagcgagtcttttgcat

SEQ ID NO: 3320 - DNA, 609 bp, Homo sapiens
aagcggttcccgagcccaggcccgcgccgagcccagcaggcacccacccacggcccttcctggtatctggaccagaccaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctg

SEQ ID NO: 3321 - DNA, 797 bp, Homo sapiens
aaactttgagcggaccgggacagaaaaaaaaatctctctttgtcttgagggggctgttgagtggtcgcggacctgggctctgtgcgttgggaaagggaagtggaggtgagcctcgggcttcccgccctgtagctgggcccgccccagttgcagcgctcagccccaccccggctgggccaccgccctgcacagtctcagggatgagcagccgcccaagctgcagggcctcgggtcttcggcgcctctgaccctcgcaggttgctgcctttcggtgcagaaccgtatgtatgtcacacattggatgtgagacctgagaaaccgtgttttaacaggtctctgaaagaagatgaatttggctgagatttgtgataatgcaaagaaaggaagagaatatgcccttcttggaaattacgactcatcaatggtatattaccagggggtgatgcagcagattcagagacattgccagtcagtcagagatccagctatcaaaggcaaatggcaacaggttcggcaggaattattggaggaatatgaacaagttaaaagtattgtcagcactttagaaagttttaaaattgacaagcctccagatttccctgtgtcctgtcaagatgaaccatttagagatcctgctgtttggccaccccctgttcctgcagaacacagagctccacctcagatcaggcgtcccaatcgagaagtaagacctctgaggaaagaaatggcaggagtaggagcccggggacctgtaggccgagcacatcctatatcaaagagtgaaaagccttctacaa

SEQ ID NO: 3322 - DNA, 748 bp, Homo sapiens
ggggctgcttctgaggaatcagcttgactggaagggtccccattccttctttccgatccgcgattaccctggactcgaagtcagcagacccggttctaggccagctctgcctctcaccctctgtgaccttgggcaaatcatacaactctgggactcagtttcttcctctctaaaacggagatgactgttgctccatcagtctcagccagcaagttcagctccggcaagtcatttgattcacccggtgatgaaatgggggtcaaccagtctgtgggctttccacctgtcacaggaccccacctcgtaggctgtggggatgtgatggagggtcagaatctccaggggagcttctttcgactcttctacccctgccaaaaggcagaggagaccatggagcagcccctgtggattccccgctatgagtactgcactggcctggccgagtacctgcagtttaataagcgctgcgggggcttgctgttcaacctggcggtgggatcttgtcgcctgcctgttagctggaatggcccctttaagacaaaggactctggataccccttgatcatcttctcccatggcctaggagccttcaggactttgtattcagccttctgcatggagctggcctcacgtggctttgtggttgctgtgccagagcacagggaccggtcagcggcaaccacctatttctgcaagcaggccccagaagagaaccagcccaccaatgaatcgctgcaggaggaatgga

SEQ ID NO: 3323 - DNA, 2880 bp, Homo sapiens
agcatttagttgggatagcttcactagagctgcctgccaaagacttccttccacaggatcttgtcgcaccagcaactgacaggagcttgggagctcgggagcttgggagagggcttatgtttttaataatgtagctgtcagttcgaagcctggaaatgttgaccctcaaaggtttattgccaaaattagataccatatttatgctgaattattaccttttcaatagttttttttgaccttgcagactactgtattctttatacctagggaagcatgtctatgtttggaacctgcaaataatttttcagtcatcttagagatgctgcagaacatcaatgccacatcttgagtcagaagtcgagggtcatttgttcaaaagttggagaaatatcctcttttgttgcttcttctactctgtagtggagaatggggaactggtagttgtgtgggagttatgtgtctctaagatttgtcgacccattttgatggcaaggtgtattcacaagtgtgtgtaaagggggtgtggatgggacaactgcatctgcctcttgtgcatgccttgggtacttgatttcatcttgttttttcccccttttgtataaaattctcaaaattgctcatttggatttgaatatgaaaggagaaatgaaatctctaaagaatgatagtaaataccttgcactgactttattttctgatatcttaaccttctagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttaccaa

SEQ ID NO: 3324 - DNA, 9438 bp, Homo sapiens
cagcgcgcgctcctgcagccccggcggagtcccggcggggagcgcccgcgtaggcaggcacccggggcagccctccgtcctcgccgcgcggcctgagaacccctgggccctgggcgagggggctgggctgtgcagcccccgaggctaactgggcgggatcgcagctgcaggggttgtgcgagcagccacggcggcacctgtgccctgcgggcacccaccctgcccctgccgaggcaggcgcccaccgccggcggtgatgcggctgtgaagccctagtcgattaacgtgacagtgtcaggtggacccacagccatcccacctccccctctggggagtgctgagagtgaggcagcatggaggagaggaagcatgagaccatgaacccagctcatgtcctctttgaccggtttgtccaggccaccacctgcaagggaaccctcaaggctttccaggagctctgtgaccacctggaactaaagccaaaggactaccgctccttctatcacaagctcaagtccaagcttaactactggaaagccaaagccctctgggcaaaattggacaaacggggcagtcacaaagactacaaaaagggaaaagcgtgcactaacaccaagtgtctcatcattggggctggcccctgtggtctccgtacagccatcgacttatccttactgggggccaaggtggttgttattgagaaacgagatgccttctcccgcaacaacgtcttgcatctctggccattcaccatacatgatctacgaggtctgggtgccaagaagttctatggcaagttctgtgctggagccatcgaccatatcagtatccgtcagctccaactaatacttttgaaagtagccttgatcctaggcattgaaatccacgtcaatgtggaattccaaggacttatacagcctcctgaggaccaagagaatgaacggataggctggcgggcactggtgcaccccaagactcatcctgtgtcagagtatgaatttgaagtgatcatcggtggggatggtcggaggaacaccttggaagggtttcgtcggaaagaattccgtggcaaactggccatcgccatcacggcaaattttatcaaccgaaatacaacagcagaagctaaagtggaagagatcagtggtgtggcttttatattcaaccaaaaatttttccaggaactgagggaagccacaggtattgacttggagaacatcgtttactacaaagatgacacacactatttcgttatgacagccaaaaagcagagtttgctggacaaaggagtgatactacatgactacgccgacacagagctcctgctttcccgagaaaacgtggaccaggaggctctgctcagctatgccagggaggcggcagacttctctacccagcagcagctgccgtctctggattttgccatcaatcactatgggcagcccgatgtggccatgtttgacttcacttgtatgtatgcctccgagaacgccgccttggtgcgggagcagaacggacaccagttactagtggctctggtcggggacagcctcctagagcctttctggccaatgggaacaggaatagcccggggctttctagctgctatggactctgcctggatggtccgaagttggtctctaggaacgagccctttggaagtgctggcagagagggaaagtatttacaggttgctgcctcagaccacccctgagaatgtgagtaagaacttcagccagtacagtatcgaccctgtcactcggtatcccaatatcaacgtcaacttcctccggccaagccaggtgcgccatttatatgatactggcgaaacaaaagatattcacctggaaatggagagcctggtgaattcccgaaccacccccaaattgactcgcaatgagtctgtagctcgttcaagcaaactgctgggttggtgccagaggcagacagatggctatgcaggggtaaacgtgacagatctcaccatgtcctggaaaagtggcttggccctttgtgcaattatccatagataccgccctgacctgatagattttgattctttggatgagcaaaatgtggagaagaataaccaactggcctttgacattgctgagaaggaattgggcatttctcccatcatgacaggcaaagaaatggcctccgtgggggagcctgataagctgtccatggtgatgtacctgactcagttctacgagatgtttaaggactccctcccctctagcgacaccttggacctaaatgccgaggagaaagcagtcctgatagccagcaccagatcccctatctccttcctaagcaaacttggccagaccatctctcggaagcgttctcccaaggataaaaaggaaaaggacttggatggtgctgggaagaggagaaagaccagtcaatcagaggaggaggaagctcctcggggccacagaggagaaagaccgaccctggtgagcactctgacagacaggaggatggacgttgccgttgggaaccagaacaaagtgaagtacatggcgacccagctgctggccaaatttgaagagaatgcgcccgcacagtccatcggcatacggagacagggctccatgaagaaggagttcccgcagaacctgggaggcagcgacacatgctacttctgccagaagcgggtctacgtgatggagaggctgagtgccgagggcaagttcttccaccggagctgcttcaagtgcgagtactgcgccaccaccctgcgcctctcggcctacgcctacgacatcgaggatggtaaattctactgtaagccacactactgctatcgactctctggctacgcacaaaggaagagaccggcagtggctcccctgtctggaaaggaggccaaaggacccctgcaggatggcgccaccacagatgcaaacggacgggccaacgccgtggccagctccactgagagaaccccaggttcaggcgtgaacggcctggaggagcccagcatcgccaagcgactgaggggcaccccagagcggatcgagctggagaactaccgcctgtccctgaggcaggctgaggcactgcaggaggtaccggaggagactcaggccgagcacaacctgagcagcgtgctggacacgggcgccgaggaggacgtcgccagcagtagttccgagtctgagatggaggaggagggagaggaggaggaggaggagcctcgcctgcccccatctgacctgggtggtgttccgtggaaggaggccgtgcggatccatgcccttctgaaagggaaaagtgaagaggagctagaggcctcaaagagctttgggcctgggaatgaagaggaggaggaggaggaggaagaatatgaagaggaggaggaggaggactatgacgaggaggaggaagagtccagtgaagccgggaaccagaggctccagcaggtcatgcacgcggcggatcctctggagatccaggctgacgtgcactggactcatatccgtgagagagaggaggaagagaggatggcgccggcctctgagtcctctgcttccggagccccattggatgagaatgacctagaggaagatgtggactcagaaccagccgagatagaaggggaggcagcagaggatggggacccaggggacactggtgctgagctggatgatgatcagcactggtctgacagcccgtcggatgctgacagagagctgcgtttgccgtgcccagctgagggggaagcagagctggagctgagggtgtcggaagatgaggagaagctgcccgcctcaccgaagcaccaagagagaggtccctcccaagccaccagccccatccggtctccccaggaatcagctcttctgttcattccagtccacagcccctcaacagaggggccccaactcccacctgtccctgccgccacccaggagaaatcacctgaggagcgccttttccctgagcctttgctccccaaagagaagcccaaagctgatgccccctcggatctgaaagctgtgcactctcccatccgatcacagccagtgaccctgccagaagctaggactcctgtctcaccagggagcccgcagccccagccacccgtggcggcctccacgcccccacccagcccactccccatctgctcccagccccagccttccaccgaggccactgtcccatcccctacccagtcccccatacgcttccagcctgccccggccaaaacatccaccccactggcccctctccctgtccaaagccaaagtgacaccaaggacagactgggcagcccccttgctgtggatgaggccctcagacggagcgacctggtggaggagttctggatgaagagtgcggagatccgccgcagcctcgggctcacacctgtggaccgcagcaaggggcccgagcccagcttccccacgcctgccttcaggccagtgtccctcaaatcctattccgttgaaaagtccccccaggatgagggactccaccttctcaagcctctgtccatccccaaaaggctgggcctgccaaagccggaaggcgagccgttgtccctgccaaccccccggtccccgtccgacagagagctacgcagcgcccaggaggagcgcagggagctgtccagcagctctggcctgggcctgcacgggagctcctccaacatgaagacactgggcagccagagcttcaacacctcggactccgccatgctcacgcccccctccagcccgcccccaccgccacccccgggcgaggagcccgccaccttgcggaggaagctcagggaggccgagcccaatgcctcggtggtcccgccgcccttgcccgccacctggatgcggcccccccgggagcctgctcagccccccagagaggaggtgcggaagtcgtttgtggagagcgtggaggagattccctttgctgatgatgtggaggacacctatgacgacaagactgaggactcaagcctgcaggagaaattcttcacgcccccgtcctgctggccgcgccccgagaagcctcgccacccgcccctggccaaggagaacgggaggctgcctgctctggaggggacgctgcagccacagaagagggggctgcccttggtgtccgcggaagccaaggagttggccgaggagcgcatgcgagccagggagaagtccgtgaagagccaggcgctgcgggacgccatggccaggcagctgagcaggatgcagcagatggagctggcctcaggcgcccccaggccccgcaaggcgtcctcagcaccctcccagggcaaggagcgccggcctgactcccccacacgccccactctcaggggctccgaggagcccaccctgaagcatgaagccaccagcgaggaggtcctctccccgccgtcggactcagggggcccagatggctctttcacttcatccgagggctccagtgggaagagcaagaagaggtcgtcactcttctccccccgcagaaacaagaaggagaagaagtccaaaggcgagggccggcccccggagaagcccagctccaacctcctagaagaagccgccgccaaacccaagtccctgtggaagtccgtcttctccgggtacaagaaggacaagaagaagaaggccgacgacaagtcctgccccagcaccccctccagcggggccacggtggactctggaaagcacagggtgcttcccgtcgtaagggcagagctgcagctccggcgccagctgagcttctccgaggactcagacctctccagcgacgatgtccttgagaagtcctcacagaagtcccggcgagagccaagaacctacacggaggaggaactgaatgccaagctgacccggcgtgtgcaaaaggcagctcggagacaggccaagcaggaggagcttaagcggctgcatcgagcccagatcatccagcggcagctgcagcaggtggaggagaggcagcggcggctggaggaaaggggcgtggctgtggagaaggcgctccggggcgaagcaggcatgggcaagaaggacgaccccaagctgatgcaggagtggttcaagctagtgcaggagaagaacgccatggtgcgctacgagtcggagctgatgatctttgcccgggagctggagctggaagaccggcagagtcgactgcagcaggagctccgggaacgcatggcagtggaagatcaccttaagactgaggaggagctgtcagaagagaagcagattctcaatgagatgctggaggtggtggagcagagagactcactggtggcgctgctggaggagcagcggctccgggagagagaggaggacaaggacctggaggctgccatgctgtccaagggcttcagccttaactggtcctgagctcccacccaacgctccattttctgttggcatccgcctggccaggcagtggcatccaaaccacccggagccgcgatctgaggaggcctggcacctccttggagtttacgctcagatgcccgtgtgctgcttggaaagtggtcgagtcccgcgtgcagtggggagccccaggtgacagtggttatctgagacggctccacctcctgggaggaggcccacctggacctcccactcagaggagcagcacggcgtgtatggcatgacgcaggggaccaccccgcgcgctccctgaggatgtgctggctgtgccccttttttccactggcacatttggtaagagagggaagctgctccccgtcagaaccacagtgcgccgtgcgaggggcactgtcttcttcatgctccctggagcaccaccaaagaaacgtaaacaataccccacgaaagcagggtcaggggtcagggtgcgatcgagacccaggatgggggcgtccagtcatgcccaccccagcatcacaggagacatggaggtgcgggcaggctcctgaattattatgcaaattaggaggacgcaggaggggtctgccctccagccgaacaccacacactggaccctaagtggccaaatgcctgggccgcttgctggctgtggcctgaggcttgtgggttgctgcattttgcttgtagttcacaaccattttgacactggaaaatgctgactttgggggacaggatgaggccctacattctaagcccccagttggcagacaggcattgtccctgttccacatttatgtcgggacaggagatgaccttttcctccgtgtttttcctgtgtttgcacgttgaaatgaagctgacaacctggcaagacgctcagccgcttcaaaccctttttgtcaattaacttattttttaatacttgaaaagaagtaacttcgtttgtgtatctttactagaggaactgatcacctgcgcccgggtgcgggagccacagcggcatctggtgcgtcctacgcgacctggtccggggctgcccggtgctcctcacgtgcatctatttattagcctttctcttcgtatcactggcctggctggcatcagggagctgcccagaacccctgtgtgggtcctcctcacagctttctgtcccctcctccacccggtgcctgcctcaccctggcgctagaccatctggaccactcatgtgatgagggtgcatttccgttctgttttgggccaggccaacagcagagctgccactctcaccctcccagtgagaattccggctctgcagaactcgcccttgtctcagtttgggggccagggcatcaccttcctccgcacatatgttaaagaaggtttcaggatgggccctcatccacacaggccaagagggtgcaaggtgggaccctggaatcatgtggctggtgagaattccctcctcccagcctaagattcacccagacggaaacgcgagtgctgcagtggatgctgggatgcaggctggtgcctctcaagcagatcagcgactcccgcccttccttccgaaggcgacgggcacctgccttgtgccggatcttcatggggacataaagggcgagccccgaatcactagctcctatagccaaactgttcctttctcacggttccgcaccagcctggctgtgtacagctcatcaagccactgagctaatcggggtggggtgcttgtccatcaaagcagtcagcacatagcccagcgaggagccatccggaccagacccgcctgccaggggcgctccagccgcctgccgcctccgtgggctggggccagctgggagcagaggcctggcccctccaaggcgtcccgcagtggagcaggctgagtggctgtgctgaccttgggctttccatgggaaccacactgtgcttcaacttgaacattcatcccagctgcaaaggagcaaagaacctgtgtcatccttgtctgtccagaagctgccatctctctcccatgcacatccgggagataacgccgctagtggccgccacagcgctgattctccacctgttctcacgtgaggcaaaggtctccttttcttttctctttacttaaaaaaggggagaggagggtttctagattccatcttcaaaccccagtcgtcccataaaattggacgtgggaaaagaccttcactgcctgcgtggcctttcccagacctctcctcgaatgccacaaaaccggtccagccccggcagagccgccttcggcccttgtagctcctgctggccccacaacagggaaacagtttgcaaagtggcttggaaggagtgtggcctagggatctgctgtaagtggccagacgtagcaggagagcccagtgtcaccttctggtcctggtcagccttaacactgtggcatcctccacagcacacacggcagcctgcagtctggaaggtggacccgagcctttgcagagaggcgccgcagagccgcaggcctgcgccccagccttctgctcccgactgtgaggacacccagttctagtagagcactttttttaaagctcccattttgtaaccactagtttgcggttgacttgagtactctggtgacttcctgcgtcaagcgttctcaagctgtgagaatgtgcgcagctccaggcaggttttctctcggagagttaagtcttcccttgaaggcagggaagcaggatggatacacatatatcacacgcataaaacaccaggtgcgggagcagcccagactcaaggctgactaaactggaggctgaataccgtggaggtccacatgcagcttccctggagggcaggccggaggcgctcccgcccctgggcttgaggatgctgcaccccgtgggcttccaggcctgcccagatgatgccttcaggcctctgtccctggcggccatcctcaggccgattttgaccagcaatgatagactcttcttaaccctttcaaaataaatttttcagtgggacagaaaggagagttaaaaaacatttttttaaaggtggtaacatctgacccacaaagggaatgggtctgttttatgcaaaataaaagtttttc

SEQ ID NO: 3325 - DNA, 1040 bp, Homo sapiens
gtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtggttttacctcggatagaggtttccagtttgtttcctcgtctcttccagacatttgttatcgctgtggtgagtctggtcatcttgccaaggattgtgatcttcaggaggatgttgaagcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctgga

SEQ ID NO: 3326 - DNA, 1833 bp, Homo sapiens
gcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggtattgaggctctgaaacaagtaactaagagatatgcccggaaacaaaaccgatgggttaaaaaccgttttttgagcagacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaagctcccaccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcagaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttacaaga

SEQ ID NO: 3327 - DNA, 1456 bp, Homo sapiens; identical to SEQ ID NO: 1946

SEQ ID NO: 3328 - DNA, 1014 bp, Homo sapiens
ctctgacacccctcattcaaaggcacctcccaccccgcacctcagccttggcggagaggactcacagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaatccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaaga

SEQ ID NO: 3329 - DNA, 3615 bp, Homo sapiens
gggagccgggaggcagcggaggagcgaccgccgccatattagggaccgcggagcccgggatcccgtcagcggcggccgcggccgggcctgcgggagctgcggaggccggaggcgggcgctgtgcggtgccaggagaggcggggtcggcgggagccagcgagccacgggagcgagccaggctaaccttgccgcgggccgagccctgcctcgccatggaccaggactatgagcggcgcctgcttcgccagatcgtcatccagaatgagaacacgatgccacgcgtcacagagatgcggcggaccctgacgcctgccagctccccagtgtcctcgcccagcaagcacggagaccgcttcatcccctccagagccggagccaactggagcgtgaacttccacaggattaacgagaatgagaagtctcccagtcagaaccggaaagccaaggacgccacctcagacaacggcaaagacggcctggcctactctgccctgctcaagaatgagctgctgggtgccggcatcgagaaggtgcaggacccgcagactgaggaccgcaggctgcagccctccacgcctgagaagaagggtctgttcacgtattcccttagcaccaagcgctccagccccgatgacggcaacgatgtgtctccctactccctgtctcccgtcagcaacaagagccagaagctgctccggtccccccggaaacccacccgcaagatctccaagatccccttcaaggtgctggacgcgcccgagctgcaggacgacttctacctcaatctggtggactggtcgtccctcaatgtgctcagcgtggggctaggcacctgcgtgtacctgtggagtgcctgtaccagccaggtgacgcggctctgtgacctctcagtggaaggggactcagtgacctccgtgggctggtctgagcgggggaacctggtggcggtgggcacacacaagggcttcgtgcagatctgggacgcagccgcagggaagaagctgtccatgttggagggccacacggcacgcgtcggggcgctggcctggaatgctgagcagctgtcgtccgggagccgcgaccgcatgatcctgcagagggacatccgcaccccgccactgcagtcggagcggcggctgcagggccaccggcaggaggtgtgcgggctcaagtggtccacagaccaccagctcctcgcctcggggggcaacgacaacaagctgctggtctggaatcactcgagcctgagccccgtgcagcagtacacggagcacctggcggccgtgaaggccatcgcctggtccccacatcagcacgggctgctggcctcggggggcggcacagctgaccgctgtatccgcttctggaacacgctgacaggacaaccactgcagtgtatcgacacgggctcccaagtgtgcaatctggcctggtccaagcacgccaacgagctggtgagcacgcacggctactcacagaaccagatccttgtctggaagtacccctccctgacccaggtggccaagctgaccgggcactcctaccgcgtgctgtacctggcaatgtcccctgatggggaggccatcgtcactggtgctggagacgagaccctgaggttctggaacgtctttagcaaaacccgttcgacaaaggagtctgtgtctgtgctcaacctcttcaccaggatccggtaaacctgccgggcaggaccgtgccacaccagctgtccagagtcggaggaccccagctcctcagcttgcatggactctgccttcccagcgcttgtcccccgaggaaggcggctgggcgggcggggagctgggcctggaggatcctggagtctcattaaatgcctgattgtgaaccatgtccaccagtatctggggtgggcacgtggtcggggaccctcagcagcaggggctctgtctcccttcccaaagggcgagaaccacattggacggtcccggctcagaccgtctgtactcagagcgacggatgccccctgggaccctcactgcctccgtctgttcatcacctgcccaccggagccgcatgctcttcctggaactgcccacgtctgcacagaacagaccaccagacgccagggctgattggtgggggcctgagaccccggttgcccattcatggctgcaccccaccatgtcaaacccaagaccagccccaaggccagaccaaggcatgtaggcctgggcaggtggctcggggccactggcggagccagcctgtggatccaagagacagtccccacctgggcttcacggcatccttgcagccacctctgctgtcactgctcgaagcagcagtctctctggaagcatctgtgtcatggccatcgcccggcggtcagtgggcttcagatgggcctgtgcatcctggccaagcgtcaccctcacactggaggaggatgtctgctctggacttatcaccccaggagaactgaacccggacctgctcactgccctggctggagaggagcacaacagatgccacgtcttcgtgcattcgccaacacgtgccctcacagggccagcgtcctccttccctgcgcaagacttgcgtcccccatgcctgctgggtggctgggtcctgtggaggccagcagcggtgtggcccccgcccccaggctgcctgtgtcttcacctgtcctgtccaccagcgccaacagccgtggggaagccaaggagacccaaggggtccaggaggtgggcgccctccatccttcgagaagcttcccaggctcctctgcttctctgtctcatgctcccaggctgcacagcaggcagggagggaggcaaggcaggggagtggggcctgagctgagcactgccccctcacccccccaccaccccttcccatttcatcggtggggacgtggagagggtggggcgggctggggttggagggtcccacccaccaccctgctgtgcttgggaacccccactccccactccccacatcccaacatcctggtgtctgtccccagtggggttggcgtgcatgtgtacatatgtatttgtgacttttctttggatttgttttgtgtttttgttgactagtcctggaaatgtttgaggctagacggggaggggccaggacccacccactgctcctgggggatgaggtcctggttttaaagccccgtcatttcaagcgggtcgatcttccacattcactggagagactctccccacctctgtctgggtggggcgcggacccctcactgtgcgcctgtgcagggggtgctggtgcacgtggcagtgtggatttccagtggtcacggtcttactgtttcaaggtttttaaataagaaaaccaaccctgccttcgcccatgcccgcccctgcccgcagttgccaaagagccgccttgtcgctgtgggcgtcagggcttggctggctcagtgcacaacccacagtggccttcagaggctcctcctgggactgggaaccgccgcagggccaggcggacggcgtgaggtttgtgttggggctggttctgcccatgctagggggtgggggagctcccaggacagaccagccttgtttctcatgtaatgcagtgacgctgtcattaaacacgtggattcatgtgtgg

SEQ ID NO: 3330 - DNA, 564 bp, Homo sapiens
gcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcgatgttttgtcaaggaaaacaagcttattggtatttctcaaagagactacacacaatactatgatcatatttctaaacaaaaggaagaaattcgcagatgcatacaagact

SEQ ID NO: 3331 - DNA, 4554 bp, Homo sapiens
ttcctgtgctggatcctgggcggcctgagggcccgcgggccagcaccatggaggacgtgaagctggagttcccttcccttccacagtgcaaggaagacgccgaggagtggacctaccctatgagacgagagatgcaggaaattttacctggattgttcttaggcccatattcatctgctatgaaaagcaagctacctgtactacagaaacatggaataacccatataatatgcatacgacaaaatattgaagcaaactttattaaaccaaactttcagcagttatttagatatttagtcctggatattgcagataatccagttgaaaatataatacgttttttccctatgactaaggaatttattgatgggagcttacaaatgggaggaaaagttcttgtgcatggaaatgcagggatctccagaagtgcagcctttgttattgcatacattatggaaacatttggaatgaagtacagagatgcttttgcttatgttcaagaaagaagattttgtattaatcctaatgctggatttgtccatcaacttcaggaatatgaagccatctacctagcaaaattaacaatacagatgatgtcaccactccagatagaaaggtcattatctgttcattctggtaccacaggcagtttgaagagaacacatgaagaagaggatgattttggaaccatgcaagtggcgactgcacagaatggctgacttgaagagcaacatcatagagtgtgaatttctatttgggaaggagaaaatacaagagaaaattataatgtaaaatggtaaaaacataagtagtttttttttcaattacatgttgcttccagacatacttctctgcaacttgttgagcaacattttaagatgttggacttctgcaatagatgacactgatggttttactcctttttttaaaaacacatgcgcgcgcacacacacatgctttacaagttttattataaaccaagaattttggacttgcaaagaggtattattgcaataatgcacttttcatacttgaaatttatttgtatgatataaagttattactttaaacaaaatgcaagtatggggggattgtttataaagtttgggtaatttataacaaaatttgctaaggtttgctaaaaattcatttttctgttctatatattacatttttaacataattttacagttcaattttatgatggagcctcttacagaaacattaacaaaatgcaggaatctgccacatttcttttttagtataacttaatagcttaattaccattttattttttatacttcttccattattaatctttaaatcatgatcctaattagctgtccttactttaacttgatctaattattgcttcctttcttattactttcctaatttttctatattttaaaaactacagtttccatgataaaaggaaaacgttttgatttatagtaccaagtgcttaaacacaaggatagtgttagattttcgagtgactttcctttttgcattttttggcagtaaaagccaaacgttgtatttgttcttttcagagttgtccagcccttttttcctttgtccaaaatgattctaaatagaatctaataaaccaatgtagcattatttttttctaaatgaagccccaaaaaagaaaagtgccttgcatcatttaaaaaaaataattaaatcctcatggcctctaaattagtatgtagaacactgaaaagttcttaacatttttgtgtaatttcctttctttttaaaccataaattagtttaaactgaaagtacgaggctggaagaaatattagtaaattatttggaatatagaatgtttactctttctttttatgttgtcttaatgattctgtgagattgttccggctcaaacagaagcttttctttggggaaggtgatttgtgggagactagtgtattttaaattagcattttaatccattcttgacattcagttagtccagatctgccccataatttgctttagtaaagtcactttatggatttttggctatgttttagtttgtgtgtataaaagttctaagaaaacatttttgctattttaagtatgtaagggaagagaggagtgtttttaactttttatagttgatgactttagggtagcacaaacaaaactcctttgtatctaacttttctcaatcctctcttgaggtgctttactaatgggaatgatttctgtatgttcccttggtaccaagaggtactatgcaaagtaacctattacaccaagttacttgctttgctttcctctctatgatgtgataatacagtaaaagctttcttacccagcatagtgggagagtggagattaattaaaattgttaattaagagttaattcctattgacccaggtgatatttctcttctgatttccctccccttcccttctcttatcttaccactgtgaaaacagcatattgttaatctcgttgtcgtccagtattctgctttgtgattaggtcttttgatgtacagtggtctagtggagtcaagattcgcattgggttttctaaaattccagttgataaaagttccagataacacagctttcctgtatatagatcactattgggcaggtcagcaaagatctcttacagtgtaataataatctatgatgcttcatttagcagaaactctgcttaaaagaatcttcataatagtaagtttaggttttaaaaacttgtttcataaatatacatatatcctctctagtagtctggccaaaagaacagattttgttattgataatttgtagctggtaattttccacattttctatccactgtaatttttatgttgtcactgaagtgcctgcccagtactgtatattacagtctctcacaaacactgggaaaagggactgtcatcatcttgagtactctgtgtgtatatatatatatatagatagatagatttttttttttttttgagacagagtctctaatgtcacccaggctggagtacagtggcacaatcttggctcactgcaacctccacctcctgggttcaagtgattttcctgcctcagcctcccaagtagctggggttagaggcacatgccaccatgcctggctaatttttgtagttttagtagagatggggtttcaccatgttggccaggctggtctcaaactcctgacctcaagtgatccacccacctcggcctcccaaagtgctgggattacaggcgtgagccactgcgcctggctgagtacaatattaatgtagacaaaccatgaagtttattatttcatataagaacattacaggtttgttttttcttgcatgtctgtccacctaatgtttaagtagttctggtagctcttcctattctttattctatttgattccatttctgtgattcttttattaccactgatgttttgtgatagttaactatgataaatttaactgatcatgatttatcttctagagtatttaaataatgtatgagtgaccacccaattccaacattaaaagtgtaatctgggcccataatttatagtgaaattgtatcaaaacatagggaaactgtattactgtccattttgaaaatatgaaacttgagtattgaaaatattcaaacatggaatggcagtattctaatttcagttagttggttcatgttaatttcttacctgttagatgtttaaactgcagtgacctttacttgtatctactctgtggtggaaatgttaaaccatgatagcttttgctaccaactcaaccacttaacttttagagcagttttggggagagtttatgcttcatctgagtttagaagtaatgtcagaaaatgttaagcatgtctgtattaagaaaatataaggtttctaattgtcttattaatatggtaattcaagtgaattagaaatatttaactgcaatcttgaattataaagttgagatatatatatatatgtatcaagatctcaacttgatgtaaagtaaatgagcagttacctggcggatttttttttttttaaataactgatttaatccataatcccataacaaacatagcttcacctcagtattttctttctttctttgttcaacagtgctccgataagggaatgctagaaaatagatgagaagtactgaaagacctttttttttaattgattagaaaagtaagtctctagggtctttgaatgctggaatttttttttttttttttgtctttcccatctgtggcagctaaaacaaaaatcactcaaaatattcaggtttacatgttagctctctctcatagggagctgccatacctcacagttcaaagtgtattctatagatcagtaacattatactgacatgtaattgcaatttactatgcagcaaaaatgattcaagaagaaaaataacctacagtgtctgtatacctttgtatacacaattgcttaagttactctgcttttaacatttgtacttggataaaatgcttatgtctgtataggaatgtcacagtgcaagatgctgctagcccaggcacaaagtattaaaattattttgt

SEQ ID NO: 3332 - DNA, 2494 bp, Homo sapiens
agtagaacggcgaggcggtgtatcacgtggctcggggacgtgtcaggggcggagcctccgcagcccctgcccgagttaaaaccggagtgtgagagagaaaagcgcttcagtagcgagaggggctgagaaagtggtgacaccgccggggtgcggagggagtccctgaaacttctcccaacagccccagggccaatcttccctcagcccactcccctcttcgccagctcccaggtccccactcctgtaccgggggtggggtggggagccaggcccgtctcccgctgggacacacacaggggccgggagcggggacgggacccccgaggcgggggggacgaaccgacagacagacggctgggcgcccgccccagcgggcaggcaggcaggaggaggcggaggcgggggtacgacggggagcactgggtctggggagtttcctctcaactatcgggggagaaactccccgcagccggaggaaagacccagacagtgttttcctcccgggggccgtgctcccccgccccgcgtagcggcggtcgccgccaccggcgcctccacctctaccatctcctctttctccaccacctcgggccccggtgtccccggccagcactatgcccatcttactgttcctgatagacacgtctgcctctatgaaccagcgcagccatctgggcaccacctacctggacacggccaaaggcgcggtagagaccttcatgaagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcaggtaggttgaataataaggtggcaaaatagttgatttttcattttgtggaaaaacacagtccagtccaaaaactacataacatgaaatgcaagtataaaacattccaaattaaaatagaatatgcacattgttcaaaggcaaaactcttaccctactatatatattttacatccctcattttttccccctctaaaatgcattggtattcaggattagaatctgaaacttttgctataaagttgacatacattggttttaatcccttgaaagttcagtaaagacctaaaaggaaaagcatcctaccacaccacactcatgttgtatgtgcaactattatagtggcttagagacactagttcgtgttcttcgtttctatattagtaaagatgttagaggaaattaatctgtttgttgcatcagggtttaatgtgaccatgttgtataactattctgaaaggtaagaagtttttcactggagtacagtcactggctgagaacatttaagttttcttttgaagcatacacagttaacaactattgcaggaagaactctgaattaaatttcaggcccagagttttgatttaaactccaaacccttggaaaaaaagactgctggaaaatatgaaagaacccttcgtttcttaacccccacaagtccttttattgcacttactttcatgtatttgaggatgagaggagctttaaatcaacaataattcactaaggaataatgcaaggtggtctattgtaacattttatgatattattgccctggaaataaaagatactgaacaatgtataatgttacatgtaacaaaggaatattatttccaaggagctcagttcttatgttgtagtgaaaagcactattcctaattatatattgggtatatgttgtattttcccaagtcccacagtccctagttttgtgagtttcgtacatttcagggaaattctttctgtgactacaacttttatttgcttcctattgaaggaaattgacttgtttctgttttaggaaattttaagcttcttagggataacttcagtgcttaagtgtctttggaaataactgaatttagttctataacatttaaaatgtacactgaaattcagagtgagcttaccaaattgaacttccaacgtttagttaggtaaatatgtactttcttaccacattaatacttttatgtttttcccatctctgctgcttttattttgcaacttttaataatttaggtagatttgcaatgaactttttggtttgtttctgtaaaatagtagtggatttccttctcttttatattcctttgtgatatgtagtgcaacacagtcttactgcttaaggttttcatccttacctctttgagttcaaagagatatttaaaacttgccattatttggttacctttatttggttgtcatgttgttagtgtatggcagaactattagtttcctctttttctgcatcacatttcataagtggtcaaggcatttggacatattcacctcctattacctattaaaaatacttcttaaa

SEQ ID NO: 3333 - DNA, 521 bp, Homo sapiens; identical to SEQ ID NO: 1926

SEQ ID NO: 3334 - DNA, 2722 bp, Homo sapiens
cgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgttacctggaagactggccaggtggaacgaggcagggcctggaagccaccagcctctctcgccctctgtagcaggagctgcgactctatggtttcatgttacgcttccattctgtgcaaggctctgtggaaggagaagctgcacacattctggcatcataacagaatttcatttcttccatctgcattcaggccaataccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaat

SEQ ID NO: 3335 - DNA, 2219 bp, Homo sapiens
cagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagagaaactcccctggtctctctatcagcaacagaaaaccaagccagatggactttgcaactaatcaagtttgggatttactgtcttctgaccaaccacagtgactgagatggggctgggaccagaagcccagtgggagtgaacagccgagggaaccagagtctggctgagcttgtggccagatatttaaactgggtccagccacacctgcaaaaccagggcaaggcagtaccgggaaactggctggagttgctgcggtttggggaagttgcacaccctttcatagatacctcccttaaccctcagtgcagattctgagaaaactccaaggcttctctgcctaacctagtataacccctgttccctactacatacatataacttttccattcccccagtaattgacccaaagtccctgcctctagctgtgcccattgtgcaatgatcagaatcccttgtttcaatagtattttgacttctttaagaatactctgtatttggaagctgaaacctcacttggatccattgttgggaaccaagtacggagccttacatagcccggaggagtttcaggagcaatgccactttcccttccatccctccctctgggtctggctcttcccatagtccattttccccttttatctcccattaatttctgtcttcctctctcaccttttccatgtctctagcatcctccaggatttaaaatcatctttacccaacttatctgtgaagtaatggcaaaagaacatctccaaattaagtactccttttcttcaaaggagtttcatgggatgtacagctagtataaaataaaaatatgggaagatgtccaatcttaaaaaccataagggcaaattaagacaaaactaagctgcccagagcagggtgagtggaaccagttttatgaataaagatgcttgtctcagcactatatgtggatatcaaaaattgtgaacaacttgaacacctatcaggaggagaatactttaatcaattatggcacattcaggagataatgttttacagtcatcaaaaattgtatatgagggccagcacggtggctcacacctgtaatcccagcactttgggaggccaaggcaggcggatcacctgaggtcaggagttcgagaccagactggctaacatggtaaaaccctgtttctactaaaaatacaaaaaagtaaccgggtgtggtggcacgtgcctgtaatcccagctactcgggaggctgaggcaggagaatcgcttgaacccgggaggcagaggttgtggtgagctgagattgcactattgcactccagcttgggcaacaagagcgaaactctgtctcaaaaaaaaattgtatttctgaagaattgttaagaacattggaaattcttgagatataatattgattggaaaaagatgaaactatatggtatgatctcaatatgtcctgatgaataaaaacataatacagag

SEQ ID NO: 3336 - DNA, 1678 bp, Homo sapiens
aagagccgcgccgcaggagaggcaggctggaccgggggctccccgggcccgcgacccccgccgtgaccccgcagcccccagctcgcccccaagatgatgaagaggcagctgcaccgcatgcggcagctggcccagacgggcagcttgggacgcaccccggagaccgctgagttcctgggtgaggacctgctgcaggtagaacagcggctggagccggccaagcgggcagcccacaacatccacaagcggctgcaggcctgtctgcagggccagagcggggcagacatggacaagcgggtgaagaagcttcccctcatggctctgtccaccacgatggctgagagcttcaaggagctggaccctgattccagcatggggaaggccttggagatgagctgtgccatccagaatcagctggcccgcatcctggccgagtttgagatgaccctggagagggacgtcctgcagccactcagcaggctgagtgaggaggagctgccagccatcctcaaacacaagaaaagcctccagaagctcgtgtccgactggaacacactcaagagcaggctcagtcaggcaaccaagaattcaggcagcagtcaaggcctaggaggcagcccgggtagtcacagccatacgaccatggccaacaaggtggagacgctgaaggaggaggaggaggagctgaagaggaaagtggagcaatgcagggacgagtacttggctgacctgtaccactttgttaccaaggaggactcctatgccaactacttcattcgtctcctggagattcaggccgattaccatcgcaggtcactgagctcgctggacacagccctggctgagctgagggagaaccacggccaagcagaccactccccttcgatgacagccacccacttccccagggtgtatggggtgtcgctggcaacccacctgcaagagctgggccgggagattgccctgcccatcgaggcctgcgtcatgatgctgctttctgagggcatgaaggaagagggtctcttccgtctggctgctggggcctcggtgctgaagcgtctcaagcagacaatggcctcggacccccacagcctggaggagttctgctccgacccgcacgctgtggcaggtgccctcaagtcctatctgcgggagctgccagagcctctgatgaccttcgacctctatgatgactggatgagggcagccagcctgaaggagccaggggcccggctgcaggccctccaagaggtgtgcagccgcctaccccccgagaacctcagcaacctcaggtacctgatgaagttcctggcacggctggccgaggagcaggaggtgaacaagatgacacccagcaacatcgccatagtcctgggacccaacttgctgtggccacctgagaaagaagggctggagtacagtggcgcaatctcggctcactgcaacctccgcctcccgggttcaagcgattcttctgcctcagcctgccaggtagctgggactacagggaccaggcccagctggatgcagcctccgtgtcttccatccaggtggtgggcgtcgtcgaggcgctgatccagagcgcagacaccctcttccctggagacatcaacttcaacgtgtcaggcctcttctcagctgttaccctccaggacacagtcagtgacaggctggcctc

SEQ ID NO: 3337 - DNA, 570 bp, Homo sapiens
ctgtctcagccagctgccctcctcctccaagctggctccacttctctaagcgccaacagcgatggaaataaatagcatgtgtacagacgcctggacccttgagaaactcagaatatttctgcatgccttcctagctcctctagcgctctagaaggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaaggatctggtactgttctggagtggcctgtagcagacactgaaccaccagccagctgcatttgttgtcctggaagtcattgccaactctgccagtcacactggggtccccagagaagtcaagatctgccggaggcgctgggcaatgaccccgggactccaggccagaggggtctgaagctgtttgggaaagcagcgggactccttgggaagatggccatggccccaagcccttccctggtgcaggtgtacacc

SEQ ID NO: 3338 - DNA, 1831 bp, Homo sapiens
ggaagtacggccggaagcccgccatagagtttagtggccagagcgactcttcagggaggtggcaggaaaggcttggaacagctgccggaggtgacggagcggcggccccgcccggtgcgctggaggtcgaagcttccagctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaaggactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggaggcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatctatct

SEQ ID NO: 3339 - DNA, 3587 bp, Homo sapiens
aattcccagagccggggctggggctctaggctgccgcggcggctctaggctgggctgctgggcgcgaggccagggcgggccgggagaggctgcgccggcggcggatcgcgcagagggcggtggcctgggctggccgaaccatggcggccccggagccggcgccgaggcgggcccgggaacgggagcgggagcgggaggacgagagcgaggacgagagcgacatcctggaggaaagcccgtgtggtcgctggcaaaagcgacgggagcaggtaaaccaagggaacatgccagggcttcagagcaccttcctagccatggacacggaggagggggtagaggtggtgtggaacgagctccacttcggagacaggaaggccttcgcggcgcacgaggagaagatccagaccgtgttcgagcagctggtgctggtggaccacccgaacatcgtgaagttgcacaagtactggctggatacctctgaggcctgcgcgagggtcatcttcatcacagagtacgtgtcatcaggcagcctcaagcaattcctcaaaaagaccaagaagaaccacaaggccatgaacgcccgggcctggaagcgctggtgcacgcagatcctgtctgcgctcagcttcctgcacgcctgcagccccccaatcatccacgggaacctgaccagcgacaccatcttcattcagcacaacggcctcatcaagatcggctccgtgtggcaccgaatcttctccaatgcacttccagatgatctccgaagccccatccgcgctgagcgagaggaacttcggaacctgcacttcttccccccagagtatggagaggtggccgatgggaccgctgtggacatcttctcctttgggatgtgtgcgctggagatggctgtactggaaatccagaccaatggggacacccgggtcacagaggaggccattgctcgcgccaggcactcgctgagtgaccccaacatgcgggagttcatcctttgctgcctggcccgggaccctgcccgccggccctctgcccacagcctcctcttccaccgcgtgctcttcgaggtgcactcgctgaagctcctggcagcccactgcttcatccagcaccagtacctcatgcctgagaatgtggtggaggagaagaccaaggccatggacctgcacgcggtcttggcggagcttccccggccccgcaggcccccgctgcagtggcggtactcggaagtctccttcatggagctggacaaattcctggaggatgtcaggaatggaatctacccactgatgaactttgcagccactcgacccctggggctgccccgtgtgctggccccacccccggaggaggtccaaaaggccaagaccccgacgccagagccctttgactctgagaccagaaaggtcatccagatgcagtgcaacctggagagaagcgaggacaaggcgcgctggcatctcactctgcttctggtgctggaagaccggctgcaccggcagctgacctacgacctgctcccaacggacagcgcccaggacctcgcctcggagctcgtgcactatggcttcctccacgaggacgaccggatgaagctggccgccttcctggagagcaccttcctcaagtaccgtgggacccaggcctgacccggagccccagccccaggggaccatgccggggtgctgcctgggcaggccatgttggggagactccagcaccgtggggctgccctcctccatgcgcctgggagcacaaaggccccggtagtgaaggaaccccccgtctcctgagagtggggctgaccctgccttgggcgccgaggggttggggggtgggtgtgggggagccgttaggcctcccaggtccttaggatcagggttgcccccagaaccccttcccatatcctccattctccgccctgagttcctacccaggctgcctggccggggccactgcctcctcagcatgcaggaggctgccctgtagggaaccccagctctggggcttgggggtgagggtcagccctggacagacctctgcccagggaactgctccatggggtctgggagagcagccatcccctgctggcaccatagacccacacaaggagcctgcacagcaagccagcggtgacacacctgcaggtgtcaggcatggcactgggcacaacagggacctggcaggagaaacagaccacagagaggtctggagttgaggctgttgtcagcaaagcccctggtcccacacagctctgccctagagccacctctttgaccctttacccaccctgagaccagaacttgcagcccctctgcagatctcctctggccactgcagcccctccaatgggctttttctctcatgcattccctggcctggaggcgtcagggaccccacatcctccctgctcctcagactcacagcccctccatgttacctcccgcacctcctccctggggcagctgctccctgggcctctgaggatgtcagctcctggctccctgcctctctcccactccactcctggctcagtcttagagatttctatgccctcatggattctacccctgccttcctggcctcttgattcttggcttgcctctcctccaattccaaacttagtgaaatggccttaagcattttaaactgtatgtatacattagcgcattcatgcctttctaaacgcatttcaaatgtcaaccaggaaggcacaccactgtattagttttatactgccgctgtaaaatttaccacaaacttagtgacttaacacaaatttattgcaattctgtaggctggaagtctgactatgggtctcactggactagaatcaaggctggcaggctgccttccttcctggaggttctaggggagactctgtctcctgctccttcaggctgctggcagaatccacatcctttcggtggcagggccaaggtccccactttcttgctgactgtaaactaaggccacttccagcttgtagaggctgcctacattccttggctcttggccccctcctccatcttcagagctagcaggttcagtctgtgtcacgaaccatttctctggttccctgcagacaggaaaggttgtccctaaggactcatgagattaggttgggcccagccagataatacatgataatctccctcctcaaggtttttaatattaaacacatctgcaggacacattttgccatgtaaactaacattcactggttccagggattaaggaatgaacctcttttgttggggaagggtggcattctgctgaccacagcactccaaccaaaagccaaaaaccaaagcaagacttactaacgcatatcaaataaattaaaggtacaaaatcgtgaatctcagttatcttaaatattccaatactatttacaaaattattcaaattctcacgccttccaactcaaaattagcaatctaaagtaatttccatatcctagatggaaaccctcatgctaaactgtctgattatgcatggttctaaatggtttcagtggcaaatacataacattgtactactgattaaactgaacttaaaagcatcaataccaccattgctgcacttaa

SEQ ID NO: 3340 - DNA, 657 bp, Homo sapiens
ttaactcttggactttgttccatgtttataacttagtatttcacgaacgccccgcggtgtttgttcatttttcccacacataatggaccataaaggtcggcttctttgctttatgactcgttctgaacaagtccttttccgcgctgtgtctcactttcctcttttgtaaaatggaaatattaactctagacgccggtctgattaggttgctttgaagatcgaaccagatgagggaagccaaatacttcataggctgtaaagtggtgaagctgaactgctaccgagttgctatttttttctcctcctccctctcaagctaaacgttctttagatcttttgtgatttcttcaggtggtctttgcgactccctaggctccgacctggaagaaatcttttttacacttccctttcacagagccctgcattttaacttccctatcagaagcgagaaaaatagttatcattttgagagggcttactctatgccaagccctgagaaaactctttacgtggattatctcgtttaatttcacaacatccttttaagttttccatggacacagcctagcagaaagacgcagccttcgtgcttcgctgactgctgaccactgacccaccgccttgatgacagcaccctcgtgtgccttcccagttcag

SEQ ID NO: 3341 - DNA, 1062 bp, Homo sapiens
gttgccattaggggactcctgaggtcctatctccaggctgcggtgactgcactttccctggagtggaagctgctggaaggcggaccggccgccatgtccacgttcaggcaggaggacgtggaggaccattatgagatgggggaggagctgggcagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaagccggaaaacatcatgctgctggacaagaacgtgcccaacccacgaatcaagctcatcgacttcggcatcgcgcacaagatcgaggcggggaacgagttcaagaacatcttcggcaccccggagtttgtggccccagagattgtgaactatgagccgctgggcctggaggcggacatgtggagcatcggtgtcatcacctatatcctcctgagcggtgcatccccgttcctgggcgagaccaagcaggagacgctcaccaacatctcagccgtgaactacgacttcgacgaggagtacttcagcaacaccagcgagctggccaaggacttcattcgccggctgctcgtcaaagatcccaagcggagaatgaccattgcccagagcctggaacattcctggattaaggcgatccggcggcggaacgtgcgtggtgaggacagcggccgcaagcccgagcggcggcgcctgaagaccacgcgtctgaaggagtacaccatcaagtcgcactcctccgcgagccccatcgtcgcgcctgtggacgcctag

SEQ ID NO: 3342 - DNA, 2226 bp, Homo sapiens
attgacaaacagagcggtcgcggcggcgactctcggcgtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccgatccacattgtttgaagttattgtgagtgcctcgaggaccaaggaaccgttgaaatttccaatttcaggaaggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataacatagtgcaagctgcctaaatatgtattatttgagaattgtgaaacagatagttatatgtatacaagtcaaagaacaacttaactattgctgcaacaggtttttcttaatggttatcctcttaaatacacctgctggtacttggtgtggttaaataggaaaattgttattaaataaagaatttgtatgaacctttgccaatgtttttgacacgttttactaattattgttcctgaattatgtttctggttttatctattttttgaggtttttttgtttgcttatttttcaaaacattcatttattgtaatgtttactagcggactagtaaacaataaaacattgattatttagctttataattcaggtttagtgctattgtcattgaacactggtattttctgtatcatataaaacattaaaattcaaataattataagcatttggcaaaaacaagagaaaagaaacttgccatattttacaagctgcaattttagaaaagctttaacttaatgatagttttatcattgttttcttgtcccaaacttatccagggccatagaagtatgaatctaattaaaacagaaatgggaattattgcacagaaatgggaaataactaattttaaatcagtcaaattggcttcttattaaatacaataattcttatgaaaatcatagtaccctattttcagacacagctgccagtttacacatttctcagtatcctgaaaggaaaaaagtatagccccacttatactatgtaaaattaccaataaaatatttttatgactacagattttgcatttttgtttacaactatttaaagagttttatgttgtatttagaatttcaacctagaaaccacacagtacttaaattctcctggggtctcctgctttctcttaaccatttgcttaatatatatctacctaaaggagacttctgaattgtaaatgaacttaaaaatagaatgtggatgcaaaatatcacataagacatcatgataacatttgaagaaaaaataaaactgtagaccctaacagttgtgatatttggtggtttcatgtggtaatgtaattttctgtttaattacagtactttttacaggcacagtggtactgtcttttttgtaagatgctagttgtgaaatacaattaattgcatacagtaaaagtctgtgattaaaacatttatatacctca

SEQ ID NO: 3343 - DNA, 2248 bp, Homo sapiens
gcagaactcgcacaagggaccttatttaggttgcgcaggcgcccgctggccatttcgtcttagccacgcagaagtcgcgtgtctagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgc

SEQ ID NO: 3344 - DNA, 344 bp, Homo sapiens
aaaacagggctcactggatccccttcatcactgtgggacctgctgcgagaaatgtttgttgtgtgctctaaagaacaactacaatcgggtgggaaatattcacaccaggtctgggcacccttttcacccttggcttctggagctgccttctgatttatctgtacctcaaccccggtgacatcgaatatgtgtttccaacctagcgcagctgcagaacctaccagcagttccgattcatcacctccaagctccttaagatgcacagtcagggcttcttgtcctgttaaataccaccccaaccccaggcctccactggagattaaaaaccttcattcaaagccaaa

SEQ ID NO: 3345 - DNA, 7648 bp, Homo sapiens
agagcctcggtggtttgcagcagtggaaccaggcaggcccagttgtgggtaggagaggccgtcacctgttgaggcctcccccccacacccccgcatcgccctgccctggcagagcccagcccccagtccccggagagcgcgcctgaggacggacggacggacggacggacagacctagggacggagggccaggggcaggggagatccaagaggccccgcgctggaatgcagttttctcgggcgagggagactttgcaccggagtggaaaatagtttggggtggggtttcgcaccgtcccctcctccccagccccgggccccctcccaggcgctttctgggagcttttagaactgcgctctgaagtttccagagagcgaggagcttttgcggcaggcagagacaatggaagaaaatgaaagccagaaatgtgagccgtgccttccttactcagcagacagaagacagatgcaggaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccaggcattccagaagtgttcctttatggatgtaaattcaaacagtcatgctgagccatcccgggctgacagtcacgttaaagacactaggtcgggcgccacagtgccacccaaggagaagaagaatttggaatttttccatgaagatgtacggaaatctgatgttgaatatgaaaatggcccccaaatggaattccaaaaggttaccacaggggctgtaagacctagtgaccctcctaagtgggaaagaggaatggagaatagtatttctgatgcatcaagaacatcagaatataaaactgagatcataatgaaggaaaattccatatccaatatgagtttactcagagacagtagaaactattcccaggaaactgtgcctaaggccagtttcggtttctctggcattagtccattagaagatgaaataaacaaagggtctaaaatctcaggcctgcaatactctatacctgacaccgagaaccagacgctgaattacggaaagacaaaggagatggaaaagcaaaatacggataagtgtcacgtttcctctcacactagactaacagaatcaagcgtgcatgattttaaaacagaagatcaagaggttatcacgacagattttggccaagttgttctaagacccaaggaggcaaggcatgctaacgtgaaccctaatgaggatggagaatcaagttcaagttctcccactgaagaaaatgcagccactgacaatattgccttcatgattaccgaaaccactgtccaggttctttccagtggggaggtgcatgatattgttagccaaaagggagaagacatacagacggttaatatcgatgccagaaaagagatgaccccccgacaagaagggactgacaatgaggatccagtcgtgtgcctggacaagaaaccagtgatcatcattttcgatgagcccatggacatccggtctgcctataagagactttcaactatctttgaggaatgtgatgaggaattagagagaatgatgatggaggaaaagatagaggaggaggaagaggaggaaaatggggattctgtagtccagaataataacacttcccagatgtctcataagaaggtggccccaggcaatcttagaaccggacaacaggtggaaacaaagtcacagccacactccctggccacagagaccagaaacccaggaggacaggaaatgaacagaacggagctgaacaagttcagccacgtggattctccaaattcggaatgcaagggtgaggacgcgaccgatgaccagtttgaaagccccaagaaaaagtttaaattcaaattccctaagaagcaactcgccgctctcactcaagccattcgcaccggaactaaaacagggaagaagactttgcaagtggtagtctatgaagaagaggaagaggatggcaccctgaaacagcacaaagaagccaagcgcttcgaaatcgctaggtctcaacctgaagacacccctgaaaacacagtgaggaggcaagagcagcccagcatcgagagtacatctccgatttcaagaactgatgaaattagaaaaaacacctacagaacattggatagcctggagcagaccattaaacagctcgaaaatacaatcagtgaaatgagtcccaaagccctagttgatacctcatgttcttccaacagagattctgttgcaagttcatcccacatagcccaagaggcctctccccgacccttgctagttccggatgaaggtcccactgccctagagccccctacgtcgataccttcagcttcacgtaagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatc

SEQ ID NO: 3346 - DNA, 3382 bp, Homo sapiens
agtcgtgcgacgccgggcggttgcgtgtggtgcgcgggggcgcgggctgcgtgtggcgcggggcggggcgcggctggtgcgcttgagaagcgatggcggcggcctgaactcacctaacaccgcagcagcaaccgggcccggccaggttcggcgttccgtgagtgaacgatttagaaatctggactggccagtgacctctgggcttgccattccagcctggtataacctctggctccatgggcagctactggctcctacagaccggatgaagcagactggagacacaagtggagaaaacctccagctggcaaatcctcagagtgtaggcctctggctgccagtcctgcccagcctgcctcatggagaggatgaattggctgagcagactggcctcccggggccctgggcaccgtatacctcaaggggccaatctccaaaccccagtcatggctgatcccgagacctgcctcatggtcttcaagaatcactggtcccaggtggtgcgaatcctggagcggcaaggccctcgggcagctcctgggggtgcagacgatctcagtgctgtgcgcaaccacacttaccagatgttgacactgctggcagaggaccgtgcagttccctcggcccccacaggccctgggcccctgctggagtttgctctgcacgaggatctgctgacccgtgtgttgacatggcagctgcaatgggatgagcttggggatggggtcgaggaacggcgggctgagcaactgaaactatttgaaatgctagtgagcgaagctcgccagccactgttgcggcatggtccagttcgtgaggctctgctcaccctgctggatgcctgtggccgccctgtgcccagtagcccagcactggatgaaggcttggtgctacttctcagccagctgtgtgtttgtgtggcccaggagccttcattgctcgagttcttcctgcagccacctcctgagcctggagccgctccccgtcttcttctcttttctcgccttgtcccttttgtgcatcgagagggcaccctgggccagcaggcccgtgatgccctacttcttctcatggctttgtcagctgggagccccactgtgggccgctacatcgcggatcactcttacttctgcccggtgctggccacagggctcagtgccctgtactcatcactgcctcgaaagattgaggttccaggggatgattggcactgtctgcgacgggaagactggctgggagtgccagcccttgcactcttcatgagttccctggagttctgcaatgcagtaattcaggtggctcaccccctggtgcagaagcagttggttgattatatccataatgggttcctggtgcctgtcatgggtcctgccttgcacaagacctctgtggaggagatgatcgccagtaccgcctatctggaacttttcctacggagtatctcagagcctgctttgctccgtaccttcctgcgattcctgttgttgcaccggcatgacacccacaccatcctcgacaccctcgttgctcgtattggcagtaactcccggctctgcatggtctctctgagtctcttcaggaccctcctgaacctcagctgtgaggatgtcctgctgcagctggttctcaggtatcttgttccatgtaaccacgttatgctgagccagaagccggctgttcgtgatgtggacctatatggacgagcagctgacaagtttctctccctaatcccacgctgttgtcggcaccacgcccccagcccacctcgtccagagcatgcctcatgggcacgaggtcctggaagcccaagtgtggactcctcttctgtgacgacagtaccccggccctccacaccatctcgtctggctctcttcctgcggcagcagagcctgggtggctctgagtctccaggcccagccccttgctcaccagggctttctgcatcccccgcctccagccctggccgacggcctacccctgcagaggagcctggagagctggaagacaattacctggagtatctgcgtgaggcacgtcgtggtgtggaccgctgtgtccgagcctgccgtacctggtctgccccctatgatggcgagcggccctctcctgagcccagtccttttggctcccggactaagaaacgcagcctactgcctgaggaggacaggaacaacgtgggggaaggggaggaggaagagctggggaggagggggcgggctgggggtgcaggggagggccctggtcacctgccccctccccagctcaatggagtgccaggatcatggcctgagggggccaagaaggttcgtctggtgccaaaggagggagctggggaactgctagagggcatctccgagggcatggcaggactagagggctttgggcaggagctccgggagctagaggtggcattgagcaatgggggaactggctcagagtcccccttagaacctccactgccccttgaggaggaggaggcctacgagagcttcacctgtccccctgagccccctggccccttcctcagcagccctttgcggactctcaaccagctgccaagccagcccttcactggccccttcatggctgtgctctttgccaaactcgagaacatgctgcagaactccgctctttcctgctcaacaccaacatggtcttccagcccagtgtcaagtccctgctgcaggtgctgggctctgtgaagaataagattgagaactttgcggcttcccaggaggacttcccagcactgctgtccaaagccaagaagtacctcattgcccgtggcaagttggactgggctgagggccctgcagcaggacctgccccacgccgttctgatcccctagtgaagagccggaggccatccttgggggagttactcctgcggcatgcacacagtccaaccagggcccggcaggcggcacaattggtccttcagcctgggcgagacggagcaggacttggcctaagtgggggctcccctggggcttcaactccagttctactcacccggggcggggcccctgaacgccaaggtgaggctcttcgagtcaagaatgctgtctactgtgcagtcattttccctgaatttctcaaggagttggctgccatctcccaggctcatgccgtcacctcgcctttcttgttggagacttcagaggaaggatctggccctctcatctcaggctgtgggcccctcaatccttaactttcttccatggacaatcagggccatgggtggcccgggctggggctagggcacaggctcctttttatgtttggaggcagtggcaaaaggactttttaatttatttcagatgaatgttttatggagaacttgttgcaatatgtataaaagggaaatctctattctgtgctc

SEQ ID NO: 3347 - DNA, 1624 bp, Homo sapiens
tttctgttgtgtagttctgattttccgaacaggtgtttagatgatgaggggttatattaagaaagtactaaagaatacgtcttatcacgtgaatcagtatctttttattcaacatggatggagtgggagtggagaccaatctgttttatattcctgcaatctgatgaggatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccaggcttcccagcagcggcttatggaccagtggcagcagcggcggtggcggcagcaagaggatcaggctccaacccggcgcggcccggaggcttcccgggggccaacagcccaggacctgtcgccgatctctacggccctgccagccaggactccggagtggggaattacataagtgcggccagcccacagccgggctcgggcttcggccacggcatagctggacctttgattgcaacggcctttacaaatggataccattgagcaggtgctttcgttgccatctcactctgagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttattttttcttaaaacatttttttttgcttgttttggttctgttctcacttttaaaggatgctgagatggtaatatgactctccatattttggtaccaattctgagactgtatgaattttcaggtggaactttagcacacactgaagcaaagttgtgaagtgcagggcgggaggtgggcgtgagctttctattttgcgttgtagaagaagtgagatgtagtaagctaattaacagactttctagcagttctttttgtgatgtctctttgttaatctgagtctatctattttcggcaataaggtaaggacgacagtgttttgagtgtcctccttttctataagtgctttttttctgttgaaag

SEQ ID NO: 3348 - DNA, 615 bp, Homo sapiens
attaggaagagtagccagggaagtggaaacttcaggctaccccctgggcttggagccctgagtctgtccccaggggctgacttcctgcattcctctagggagttcctgacagctggattctagaagtagaactatgagctcacctttggcctcccttagcaagacccgaaaagtgcccctgccctcggagcctatgaatcctgggaggcgaggaatccgcatctatggagatgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccagggggactcattggcgccccctg

SEQ ID NO: 3349 - DNA, 782 bp, Homo sapiens
ttcagtgcagtcaccggcacagcagcaggtacctgccagacctggggctccctctgttcaagtgccatctccttttctacttcaaaaccaatatgagcctgttcagccccactggttttactgcaaggaggtagaatacaaacaactgtggatgccttttagtgtgttcgactctttgaatcttgaagaaatctataattcagttcagccagatccggagagcgtggttcttggcacggatggagggcgctacgatgtttacctctatgaccgaataaggaaggctgcctactgggaagaggagccagccgaagtgagacgctgtacttggttttacaagggggacacagatagtcgatttattccctatactgaggagttcagtgaaaaactagaggtacgggtgctttatttctttatgagtttctttaaaaaatgtaggtcctatatacattggtgagtaacatcattcacagtggagcggactttacttacaagacagcttgttttgatgctgttcacagagaagattactttttaagtggtgtcatcactcatgaggtgctaatcgtggcatctgtgtctaaagatagaatatgatttgcagagacacatcacagatctaataaggtgcttgtgtcaagccttcaatagaacctaggccgctgggatttgttgttgatagaagatgccaagcatatggacattttcaaattagtattcagtaaaaggcttgaaattaacctctgatttgtgaaaataaataaatagaattggaagaa

SEQ ID NO: 3350 - DNA, 1544 bp, Homo sapiens
ctgagctcctgtgtgtagagcgttgtgctcggtgctgtttgcaagggaatcaaagaagtaggagatgatacttcctcttcttgacagccttatggttaaggtaagaagaaagcagcggcattgttcgacagccaggccccaatttgccccatctgccaggtcctgctgaggcccagtgagctgcaggagcatatggagcaggaactggagcagctagcccaactgccctcgagcaagaattcccttctgaaggatgccatggctccaggcaccccaaagtccctcctgttgtctgcttccatcaagagggaaggagagtctccaacggcatcaccccactcatctgccaccgatgacctccaccattcagacagataccagacctttctgcgagtacgagccaaccggcagacccgactgaatgctcggattgggaaaatgaaacggaggaagcaagatgaagggcaggtatgtcccctgtgcaaccgccccctggcaggatcggagcaggagatgagtaggcatgtggagcattgcctttctaagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtg

SEQ ID NO: 3351 - DNA, 2744 bp, Homo sapiens
gcggcgccgggcttcccacggacggggccccgcggggttgcccggccgtgcccgctgtgcccggctctgcccggcgcggccgcggagcgcacgcctcctgcctgctgaccctctcgtttggtttctcgcaggcctctgccgcagacatggagaaactcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatccccgctctgccacccggcctacgccgacagcgtccccacctgcgtcattgccaaggtgctggagaagccggaccccgccagcctgtcctcccgcctgtccgatgcctccgcccgcgacctggccttctgcgacggggtggagaaaccaggcccgcggcccccctacaagggagacatctactgcagtgacacagccctctactgcccggaggagcggcggcgagaccggcggcctagcgtggacgcgcccgtgaccgacgtgggcttcctgcgggcccagaactccactgacagcgcggccgaggaggaggaggaggccgaggcggcggccttcccggcgggcttccagcatgaggccttccccagctacgcaggctcactgcccacgtccagctcctactccagcttcagcgccacgtcggaggagaaggagcacgcgcaggccagcacgctgaccgcgtcgcagcaggccatctacctgaacagccgcgacgagctcttcgaccgcaagccacccgccaccacctacgagggcagccctcgctttgccaaggccacggccgcggtggcggccccgctggaggccgaagtggccccaggcttcgggcggaccatgtcaccgtacccggccgagaccttccgcttcccggcctctccgggtccccagcaggccctgatgcccccaaacctgtggagcctgcgggccaagccggggaccgcccggctccccggggaggacatgaggggccagtggcgtcccctgagcgtggaggacatcggcgcctactcctaccccgtgagcgctgccggccgcgcctcaccctgcagcttctctgaacgctactacggcggggccgggggcagcccgggcaagaaggccgacggccgcgccagcccgctctacgccagctacaaggccgacagcttctccgagggggacgacctctcccagggccacctggcagagccctgcttcctgcgggcgggcggcgacctgagcctcagtcccggccgctcggctgacccactgcccggctatgcacccagcgaggggggggacggggacaggctcggggtgcagctgtgtgggaccgccagcagccctgagcccgagcagggttccagggactccttggagccgagctccatggaggcctccccggaaatgcatcctgccgcccgcctcagcccccagcaggcctttccgcggactggtggctcggggctgagccgcaaggacagcctcaccaaggcccagctctacggaaccttgctcaactgagcgcctgcgtgcaggcctggccgtggttcgctccccgccagcccacgtgccccagaagggccggcctcacctctccccagcccccgctgttcccctgccccggccaacaacgaggagtctgttcctccccgcacctcctctcctccccagccctgtaggcctgaggggagggtcccccacaccacggtgtccacccggccccggcccgtggaactccacttagagcgtttttcacgcgtccttcccccatgtgagaggagcatccccccttttataaagcgaaactatttttatagagaaaaagggtctttcttaacgcacttggcctccagctccctggacggctgccttggcgttttcaacacaaagctcctttattttttgggcgagggtgcgtggggcctgccccttggaagggaagggaaggacggtgtcctgtggagaccagactctgcaagtggggagaccacccccgcaagccagtgacaagggagccctgaagttgtgtccacgaagagggagctgaaacaaattcggggctatgaagtgttttaaaaatccattcttcgcagtgtggccaccacaccgccctgagccctcccacggcccatcgtcccgggtgggccgggatgatgccccagtgcggccggtgctcatctccgcccccgggtccgccccctgacaccgtcttactctacctcagacatgaggaggccctccattcctggtttctgtagcttgcattcttgttgtctctgatgcatgccctgccagttagtactgtattttgcattcattaataaaagacaccggtgg

SEQ ID NO: 3352 - DNA, 456 bp, Homo sapiens
cttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcaggtgtcaacctagatggaaagaagattttggtagtgggggcccatgggtctttggaagctgctctacaatgcctgttccagagaaaagggtccatgacaatgagcatccagtggaaaacacgccagcttcaaagcaagacggagtctcgttctgtcaccaggctggagtgcaggcgcgtgatctaggctcactgcaagctctgcctcccaggttgaagtgattctcctgtgaaagggaattatttttgatgagtcattaaagtatatccattcccagaa

SEQ ID NO: 3353 - DNA, 1533 bp, Homo sapiens
attggctgacaggtgatttctggatgtcaggaacatttctgattaggaaaccacagcttctccagggagtctatgccatgggcttcaatcgaccctccaagatacaagagaacgcattacccatgatgcttgctgaacccccacagaatctgattgcccagtctcagtctggcactggtaaaacagctgcctttgtcttagccatgctcagccgagtggagccatcagacagatacccccagtgtctgtgcctctccccaacatatgagctggcgcttcaaacaggaaaagtgattgagcagatgggcaaattttacccagaactgaagcttgcctatgccgttcgaggcaataaattggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcagaagtagagagaaactacctacctcacttcaaattatgtttggacttgacaaaaataggtgcaaatgatggggggcaatagaagaaaaaatttgcattttggaaaattgggtcctttccccacttttttaaagccacattcccccatctttataataatctggtcacagtggtagtcgctggccccaggaccccctcctgattttggctaggcatcgtggaaccagctccagcccctgaaga

SEQ ID NO: 3354 - DNA, 5961 bp, Homo sapiens
ttgagacaatgttataattataattgcccttcctttttggctgctgctttagccagagccacatcagatgaagtccttcagagtgatctttctgcacattatatcccaaaggaaacggatggcacagaagggactgtggagattgagacagtgaaattggcccgttctgtcttcagcaaactacacgagatttgctgcagctgggtgaaagacttccccctccgcaggagaccccagctttattatgagacatcaatccatgccatcaaaaacatgcgcaagctattctataaacatataagcaaaaaaaaaaaaaaaagaaagaaaagagattgggaccaggaagaacaagcttactttgcagtgtttgatggccatgggggagtagatgctgctatttatgcctccattcacctccacgttaacttagtccgccaggagatgttcccccatgatcctgctgaggccctgtgcagggccttccgggtcactgatgagcggtttgtgcagaaagcagccagggagagcttaagatgtgggaccacaggagtggtgactttcatcagaggcaacatgctacatgtggcctgggtgggtgattcccaggttatgcttgtgagaaagggccaagctgttgaactaatgaagccacacaaaccagacagagaggatgaaaagcagagaattgaggcccttggaggttgcgtagtctggtttggtgcctggagggtgaatggaagtctgtcggtttccagagctattggagatgctgaacataagccatatatctgtggggatgcagattctgcctccactgttctggatgggaccgaagactacctcattctggcctgtgatggcttctatgacaccgtgaaccctgatgaggcagtgaaagttgtgtccgaccacctgaaagagaataatggagacagcagcatggttgcccacaaattagtggcatcagctcgtgatgctgggtcaagtgataacatcacggttattgtggtattcctgagggacatgaacaaagctgtaaatgttagtgaggaatcagattggacagagaactcttttcaaggagggcaagaagatggtggggatgataaggagaatcatggagagtgcaaacgcccttggcctcagcaccagtgctcagcaccagccgacctaggctatgatgggcgtgtggattcattcactgatagaactagcctgagcccagggtcccaaatcaacgtgctggaagacccaggctacctagatctcacacaaatagaagcaagcaaacctcacagtgcccagtttttgctaccagttgagatgtttggtcctggtgcaccaaagaaagcaaatcttattaatgagttaatgatggagaaaaaatcagttcagtcatcattgcctgaatggagtggtgctggagagtttcccactgctttcaatttgggttcaacaggggagcagatatacagaatgcagagcttgtctcctgtctgttcagggttggaaaatgaacagttcaaatccccgggaaacagagtttctagattgtctcatttacgccaccactactcaaagaagtggcacagattcaggtttaatccaaagttttattcatttctctctgctcaagagccttcccacaaaataggcactagcctgtcctcacttactggaagtgggaagagaaataggataagaagttctctgccatggaggcaaaatagttggaaagggtacagtgaaaacatgaggaagctcagaaagactcatgatattccatgcccagatcttccttggagctataaaatagaataatttttctttcaagtaggttagctagctctcccccaataaaaataccactatcagagtagaaacaaggtagacatttctaaaacatatgtgcttcattatgaatccatggatggctcaattcttaaatgtaaatagatctctaggaaactcaaagtacagtgttttcaatctaaaaagaagtattggcagtttcacttgcaaaattacacagctggtccctgtgatgtgtctcgacaccaatacacaacccccttcccaccatccttcatgtcactagatacacaacccccttcccaccatcccttcagtcactagtggaagctttcaagttagttatttcagtcaggatatacagtgttgaaatctcaatgcagttgaaatctggtctgatgtgcctaatttatctgtggaaaatttaatgctgaattacatttggttgggaaatgtccctcaaaatcctgggcactatgaaggaaccccctgccccctcacctttttgggtaggtaaaagactaaaagccatatggattttaactgataacaatgaaagtggtaaatcagtgtaaaagtgtcatattctcagacttgtgaggcggtttatagtcagaaagatttacggatttttttcctgtaacataaaagattgtgaactttttttaattaaaaaatatttcctagggctgtagttatttgggagtttcataacctgttatggtgcttttggtggaaatttttattatttagcattttaggagaccgctgtcaactggttttaatctatgatgctaatgtgttttccactgtaccctcatctcaggaataaaactgctttaacggagatgatgtcaggtacaaatacactatagagtcaaaataccatttacaaagaaaatcaaaagcatttctatattttgtctttttttagttcagacagcaaaggcatgtactactataaaatacaaagtgattttagagaatgaaaaatgctacttttatcttctctaaaattatttcccccaaggtagtgaagtaattggaatgaaggaggctgaaagtattgtctaaagtgagcccagaggccactgagaatgcagattactgacagccaggtctgtttagttgtaattggaagacacatgagtgtcctgcttacatgtagcttcagactgcagagacaggacgtgtgcttttcatttcaatatttagttatatttgatattttgaaactgtctgctttttgctatttctgcagtttcaagttagttagaagcatgttgtcaactaaagacaacaaactatcagattcattcattcagtgaagcagcctctgattctctaagagtcacgaatgtcttagtgttaccctcccctagtcaacagcagaccagcctggccaatgcctatgggtggcccctctggagtgctcactaacaagggtgagtgctctcgctaagaagtgtcccccgcctaatcatgtgtttataggatagtacacgttccccaggcccataacagaggactaaaatctctgaattttaaagacacagatgactggcatattttggataccagtatagctatatcaaatagacaaaaacagcttcactttagcaatgatcagattgttaatctacagattttattttttaaaatttggatgtaagtagagactttcagtatttgttttctcttgattttgaagtcatttcttcttctcacgtctgtgacaaatggttgaaaaggagtcaacatggccccaactatagtgccggaaccttttcatcattctgaggctttgccccacacatggtcctcactcatatctgtcaccttctgaagcctagatcttgttaacccatcaggtgcagtgtcagtttcaaatcaaattatctaagaaaacaagaaaacaaaggcagcagactattggtacacattatagtccaaagtgcttagcgaagtaaaaaaaaaagctttttaaaatttctattgttgtctattggtaatgtttttgatcagaataaagagggtaaagggaaaaagttactacacatgctaggctttctcagtggggaaaaaaatggctggatagaactgggacaaacacagacccatctttaggggtctggattttgtaggtccgactacacagcagtgttaactcatttctcatgccattagctctctacaaaataaagcaaagtagttctagtgtggtcgttataaaccaatattgtgaaaaatagcaactattcatttgttcacaacatgcgtatttatagagtagttaggtaccatttgtaaggtaaatcctttaaaattctataatacatactaaaatagtggttattggtctgatatatgctgctcttggttctataaactagataaaagcagtgctttgtgaaatgcagtgttctctcttaacgccactggtgataggaagtagttcccttcagttcaaatcctgtgcccttatttgctgcttgctgacgtaagcaataagtaaccctctaactaatggtatctacatatttctgtaacttgtatttaatgatggtgtacctggtgattgtaaaaatattagacagatataaaagtatctatataatatctataaactgttaatgctgaggtatagtctgtgaattatgtgttttgtatttttattcattgtgtaatttagtggtggtgaaagttctacactcaatccttaaagagtggcagtatccctttttcaatttaacatggtctgcatcaatctgtttgcctgctaaacaagttagaataggaaatagtaaaataaatccaaacaagagtgtaatattggttagggaaacaaacttcaggtcaccaactgaagtcattacaaactccttgtacattcactgtgagtttcaaagggagtcagtccctaatttacaggtttcctttgttcactttctagatgtgtacttttgagggacatgaggttaggcaacattacagcaacacacactggggctattaatcccatttaggtctgtactaaagaggatgggtagaaacacatatgtatataccttttctttacctagaagtgccatccattgtccttgaattattatgattaaagttactgttgcatttaggaggctccttgaaagtaacaccttttccaaggacaatggcaacaatgtcaatgtcaacactgagtctaattttgaccacatttatagtggtatagtgtcaatactgcattttcatgacaaccacactccactgttgaaacactgtgccagtgagaagtgcaacatccagtgggcagatgaaaatgatgcatggccaagttcagtgtttacagataaaactgctgtggttcaagtgcttccttccccatcaaatccttgataaggctttgtgggaaaatgatctaaattattgttttaatttttaaacctaatttattcactcagtgaacattcttacctaagcaaggctataaaagggaatactacagttttgtccacactttaatttgagaccatttttctttgaatcgtaagttagcaaaagaaatttttttcacctttgaaaatcacgtgatgttaaaggacaaatgcccactcttctattctgatctgcaaatagcttaaatgtctcttgcaaaacaaagtaagataccaccagtattacaacacaatgattttccagacaaatggtatggtgttgaaaaataactgttacttcttaaagcagcattttatcttctattttgaagactatttattgtaataattagaaaacatgaaatagggaactccagactgacacagcagttgtttttgaaaaggaaataaactttgatgaattagataatccagatacatcattgtaaactcttactctaggtgctctttggtgagagacaggctttgttctcttgttcataacatttctctgcaaagaattctctatggagtgaagcgaatgaagtgaataatttcttaccaaataaatttatcaatttacaaatctgctctacatctcacttttgagttcagttgtagtcatgagtgatccttcatattttattaaaagtgttcattcaggtaaggtgtatgttgaaattttgccaattatcttaataaaacctggcaattt

SEQ ID NO: 3355 - DNA, 1085 bp, Homo sapiens
actcccagactccttgcggagctcgccgcctgattctaggctggtcactactccgagcctgtgacgtttgcggcagccaggccgtcgacgatgcccagtgaaactctctgggaaattgcaaaagctgaagtggaaaaaaggggaattaatggaagtgaaggtgatggagctgaaattgcagaaaaatttgttttcttcattggcagtaaaaatgggggaaagactactattattctaaggtgtcttgacagccaaaagatatcgctcacttttgggaactcggtggaggaacctctttattggacttaatcagcatacccatcacaggtgacaccttacggacgttttctcttgttctcgttctggatctttcaaaacctaatgatctctggcccaccatggaaaatctcttgcaagccacaaaaagccatgtagacaaagtgataatgaaactgggaaagacaaatgctaaagcagtttctgaaatgagacagaagatctggaataatatgccgaaggatcatcctgatcatgaattaattgacccatttccggtacctctggtcataattggaagtaaatatgatgtttttcaggattttgagtctgagaagagaaaggtaatatgcaagacacttcgatttgttgcacattattatggagcatcattaatgtttaccagtaaatcagaagctctattactaaaaatacgtggagttatcaaccagttggcatttggcattgacaaaagcaaatcaatatgtgtggatcagaataaaccgctgtttatcacagcaggattggattctttcggtcaaataggatctcctcctgttcctgaaaatgacattggaaagcttcatgcccactcacctatggagttgtggaaaaaagtgtatgaaaagctctttccaccaaagagtattaacacgctgaaagatatcaaggaccctgcgagagatcctcagtatgctgaaaatgaagtcgatgagatgagaattcagaaggatctggaactggaacagtacaaaagaagttcttccaagtcttggaaacaaatcgagcttgattcttgaacctatttc

SEQ ID NO: 3356 - DNA, 932 bp, Homo sapiens
cgccgctgaaggtacgcgtgagggcctgcgctggagccggcttgacaggtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactagacagggtcttgccatgttctggaactcataggctcaagtaatcttcctgcctcaacctcccaaagtgctggaattacagttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtat

SEQ ID NO: 3357 - DNA, 615 bp, Homo sapiens
cacctcgctcagcagggcctctcaggggtcctcagtctggcccaaggaccagggcctcagcctagccccaagagtgggccacaaccttcagcttcctgctgggaaaacccaggagaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgag

SEQ ID NO: 3358 - DNA, 580 bp, Homo sapiens
ttagtgctttttatcgtcttaaggaggtatttggtggaggctctttgaagttgggttcaggagtgtagaattggcaaagttattgccagcttcctgcatcaacaacagcaacttgtgattggcggtgaccggatattcagttgcacatccccacatcaatgcactgccaatgatgaggaaactgaggccttggactagaacagaggtctcctgactcagtccaggactctttctattacatcatgcggcctgatatttgtctttatggaactcagcaacatcacatacaggggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgt

SEQ ID NO: 3359 - DNA, 1502 bp, Homo sapiens
agttggcaagatggcgccggtgggggtggagaagaagctgctgctaggtcccaacgggcccgcggtggcggccgccggcgacctgaccagtgaggaggaggaaggccagagcctatggtcctccattctgagcgaagtgtccacccgcgccaggtccaagctgccgtccggcaagaacatcctggtcttcggtgaagatggttctggtaaaacaaccctcatgactaaactacaaggagctgagcatggcaaaaaaggaagaggcctagaatatctctacctcagtgtccatgatgaggaccgagatgttgtgaaagattttcaagactatatggaacctgaagaaggttgtcaaggttccccacagagaagaggccctctgacctcaggctccgatgaagaaaatgttgccctgcctctgggtgacaatgtgctgactcataacctggggatcccggtgttggtggtgtgcacaaagtgtgatgcggtgagtgtcctggagaaggagcacgattacagggatgagcatttggactttatccagtcacacctgcggaggttctgccttcagtatggagctgccttgatttacacatcagtgaaagaagagaaaaacctcgacttgttgtataagtatattgttcataaaacatacggtttccacttcaccacacctgccttagttgtggaaaaggatgccgtttttatacctgcaggctgggacaatgaaaagaaaatagctattttacatgaaaattttacaaccgtgaagccggaagatgcatatgaagactttattgtgaaacctcccgtgagaaagctggtccacgacaaagagttggcagcagaagatgagcaggtgttcctaatgaagcaacagtcactccttgccaagcaaccagccactcccacgagagcttctgaatctcctgcaagaggaccctctggctctccaaggacccagggtcggggagggccagccagtgtgcctagctcctccccaggcacgtcagtaaaaaagccggacccaaacatcaaaaataatgcagcaagtgaaggggtgttggccagcttcttcaacagtctgttgagtaaaaagacaggctctcctggaagtcctggtgctggtggggtgcagagcacagccaagaagtcaggacaaaagactgtgttgtcaaatgttcaggaagaactggatagaatgactcgaaagccagactctatggtaacaaactcttcaacagaaaatgaagcctgaacctccttaaaaagtgcatatgtcgaatgaccaaataactatgtatattgatctgctaagaccaggatttttctgatatggcacatgctatcagttttttggggcaggggagatgaactttaaaaaaaaaaaaaaaacttcattggcttgtccgagtgtgaaatgcacatttaggaaggttacatgtcagaccctttgttaaggataacccttggactctggggcatgtggctcttttgtggga

SEQ ID NO: 3360 - DNA, 2672 bp, Homo sapiens
gaatctccgctgtagcgtcacctggaaggcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaagttgaattcaagctaaataaagacacatcgtcattccccggtagacttttacaacatgaccttgaaagaaactactcaagtaggcaagattttaccaagaatataaagaatgtaaaatgaggtccatcacccaaggagcttgtagatttatttgggaagacaagggctacatatctggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatctaaaaagcttagatgtcttggatcttcatggaaatcagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtgagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaggaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtc

SEQ ID NO: 3361 - DNA, 430 bp, Homo sapiens
cgccttgggaggtatgaggtagagaaacgctgtgccgtggagaaggaagactacgatctcgccaaggagaagaagcagcagatggagcagtatcgtgccgaggtgtacgagcagctggagctgcacagcctcctggatgccgagctgcattctgcagtagacccgttactccctgccacagatcctcatccaaagatcaatgcagagtccctgccctacgatgagcggcctcttccagctattcgtaagcattatggggaggcagtggtggagccggaaatgagtaatgcagacatcagcgatgctcggaggggaggcatgttaggggagccagagcccttaaccgagaaggccttgagagaagccagctctgccatcgatgtgttgggagaaaccttggttgctgaggcctattgtaagacgtggtcct

SEQ ID NO: 3362 - DNA, 4599 bp, Homo sapiens; identical to SEQ ID NO: 516

SEQ ID NO: 3363 - DNA, 850 bp, Homo sapiens
agaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcaga

SEQ ID NO: 3364 - DNA, 1210 bp, Homo sapiens
gagggcaccagtggtaagacagcgctgcacctggctgtggaaacccaagagcggggcctggtacagttcctgctccaggctggtgcccaggtagatgcccgcatgctgaacgggtgcacacccctgcacctggcagctggccggggtctcatgggcatctcatccactctgtgcaaggcgggtgctgactccctgctgcggaatgtggaggatgagacgccccaggacctgactgaggaatcccttgtccttttgccctttgatgacctgaagatctcagggaaactgctgctgtgtaccgactgaagccagtacagtcctgagccgaggaggagggactgcaagtggaagagagccagtctggaaggaagagctttccaggtggacagggcttcttggaagacccccaaagccccaggtatcctgggtgaagcctgtttgcctctcttgaaaatggcaggtgctcttgttttacccatgttgggtcagcctgaaactgccaaccagtaggaagcatggactctcctgagtgagaagagactgaaataggagcaagcagaaccctgagaggtgtcccatcttattgctgttgaggaccctgaaacaccgttgtttaaagacttcacacagaaggctctgaactgagccactggggaagggaagtttcagtaacatgacactaaaatggcagagacgttaaaaaaagtttttcccttctagagctgttttgcgcgcatgcatgtctgtgtgcattggggctttttagacaggcctgccctgtgactttgtggtagaggcagagagaaggaaattgtcccctgagcacggtagggccttgctgggtggggtcagaggccagtagttccaggcctttctctgtgtccagcacagacccttgtccttgctgtggaaatgatgagggatggagggacaagaggaagaatgagaggacacacgccctggagccctcaccactgccctgggggttgccatctggaggagcctggggataagggtaacccagggaggctgggcacgagggagctgactccacgtttttccccccgttcctcaccttcgagggccctgctaggtcacccctatgctggcatgaagagcatggggcaataaaccagcacagtctctgaccacttggagcgtctcatccagtgagagagacagccgttaaaagcataaacatccaaataaa

SEQ ID NO: 3365 - DNA, 15137 bp, Homo sapiens
cctctgcggagccgggctcgggtcgccggagccgcgccccaccccgccagctccagagccacgactaatggctgaaggataaatcaacatggcaactatgattccaccagtgaagctgaaatggcttgaacacttgaacagctcctggattacagaggacagtgaatctattgctacaagagagggagttgctgttctgtattctaaactggttagcaataaggaagtagtacctttgccccaacaagttttatgcctcaaaggaccacagttgccagactttgaacgtgagtctctttcaagtgatgagcaggaccactatttggatgcccttcttagcagccagctagcattggcaaagatggtatgttcagattccccatttgccggggcacttagaaaacgactgcttgtactccagcgtgtcttttatgcactttctaataaataccatgacaaaggcaaggtgaagcagcagcagcattctccggagagcagttctggttcagcagatgtccattctgttagtgaacgcccccggtcaagcactgatgcacttatagaaatgggtgttcgaactggtctaagtttattatttgcgcttctaagacaaagttggatgatgcctgtgtcaggacctggtctcagtctttgcaacgatgtcattcatactgcaattgaagttgtgagctctttgccaccattatcattagcaaatgaaagcaagattcctcctatgggcttggactgcttatcgcaagtaacaacatttcttaaaggagtcactattcctaattctggggcagacactttaggtcgtagattagcttctgagttgctgcttggtttggcagctcaacgaggctcattgcgatatcttcttgaatggatagaaatggctttgggggcttcggcagttgtacacaccatggagaaaggcaaactactctcaagccaggaaggaatgatcagctttgactgctttatgaccatattaatgcagatgaggcgttctttgggttcatctgctgatcggagtcagtggagagaaccaaccagaacatcggatggcttgtgctccctttacgaggcagcattatgtctctttgaagaggtttgcagaatggcttctgattattcgagaacatgtgctagcccagatagcattcagactggtgatgctcccattgtctccgaaacctgtgaggtttatgtttgggggagcaatagcagccatcagttggtagaaggtacacaggagaaaatactgcaacccaaactggctcctagtttctctgatgcacagaccattgaagctggacagtactgcacttttgtcatttctacggatggctctgttagagcttgcgggaaaggcagctatgggagactgggccttggagactccaataatcagtcaactttaaaaaagttaacattcgagcctcacagatccattaaaaaggtttcatcttctaaaggatctgatggtcacactttagcctttacgacagaaggagaagtcttcagttggggagatggtgattatgggaaactggggcatggaaatagttcaacacagaaatatcccaagcttattcagggacctctacaaggaaaggtagttgtttgtgtgtcagctggatacagacatagtgctgctgtcacagaggatggggaattatacacatggggtgaaggagactttggaagattaggtcatggtgacagcaatagtcgtaacattccaacattagtaaaagacatcagcaatgtaggagaggtttcttgtggcagttcacatactattgctctgtctaaagatgggagaactgtatggtcttttggaggaggagacaatggtaaacttggtcatggtgataccaacagagtgtataaacctaaagttattgaagctttacaaggaatgttcattcgcaaagtttgtgctgggagccagtcttcacttgctttgacatcaacagggcaggtctatgcttggggctgtggagcttgtctaggttgtggttcttcagaagctactgctttgagacccaagcttattgaagaactggctgccacaagaatagttgatgtttctattggagacagtcattgtttggctctttctcatgataatgaagtttatgcctggggcaataactcaatggggcaatgtggtcagggaaattccacaggtcctattactaaaccaaagaaagtgagtggcttagatggcatagctattcagcagatttcggctggaacatcacatagtctggcatggactgctcttcctagggacagacaagttgttgcatggcaccgaccttattgtgtagatcttgaagagagtaccttctcacacctgcgttcttttcttgagagatactgtgataaaataaacagtgagattcccccactccctttcccttcatcaagagaacaccacagttttctcaagctgtgcctgaagctactttcaaatcaccttgctcttgcacttgcgggaggggtagctaccagcattctcgggaggcaggcaggtccacttcgaaatttgctcttcagactgatggactcaactgtcccagatgaaatccaagaggtggtaattgaaactttatcagtgggagcaaccatgctgttacctccattacgagaacggatggaattacttcattctcttttacctcaaggacctgatagatgggaaagcttatctaaaggacagagaatgcaactggatatcatcctgacaagtttgcaagatcatacccacgtagcctccctacttggctatagttcaccctctgatgctgctgacctatcttctgtgtgtactggctacggaaatctgtcagatcaaccttacggcactcagagctgccatccagatacccacctggctgaaattttgatgaagaccctcttaagaaatttaggattttatacagatcaagcatttggagagctagaaaagaatagtgataaatttctacttggaacatcatcatcagaaaacagtcagcctgctcatcttcatgaactgctatgttcactacagaaacagctgctggcattttgccatatcaataacattagtgagaactcaagcagtgtggcattgcttcataaacatcttcagcttttgttgcctcatgccacagatatttattcacgttctgcaaatttgctcaaagaaagtccttggaatggcagtgttggagaaaaattaagagatgtgatatacgtctcagctgctggcagtatgctctgccagattgttaactccctgctgttactccctgtgtcagtggctcggcctttattgagttacctcctcgacttgttgccacctcttgattgccttaatagactcctgccagctgctgatcttttagaagaccaggagttacagtggcctcttcatggagggccagaactaattgatcctgctggtctgccattacctcagccagctcagtcctgggtatggcttgtggatctagaaagaacaattgctctccttattgggcggtgtcttggtggcatgcttcagggctcccctgtgtctccagaggaacaggacactgcatattggatgaaaacgccactgttcagtgacggtgtagaaatggacactcctcaattggataaatgtatgagttgcctgttagaagtagcactttctggaaatgaagaacagaagccttttgattataaattgcggcctgaaattgctgtctatgtagacttggcattgggttgttctaaagagcctgcccgaagcctttggatcagcatgcaggactatgctgttagtaaagattgggacagtgcaactttaagtaatgagtcactcttggacactgtgtctagatttgttcttgcagctcttctgaaacacacaaatttacttagtcaagcatgtggagaaagccgatatcaacctggtaaacacttatcagaagtgtaccgttgtgtatacaaagttcgaagtcgtttacttgcttgcaagaaccttgaacttattcaaacaaggtcatcatcacgggacagatggatatcagaaaaccaggactctgcagatgttgatcctcaggagcattcatttactcgaactattgatgaagaagctgaaatggaagaacaggctgagagagaccgggaagaggggcatccggagccagaggatgaagaggaggaacgggaacatgaagtgatgacagctggcaaaatctttcagtgtttcctctcagcccgtgaagtagctcgtagccgagaccgagatagaatgaacagtggggcagggtctggggctcgagctgatgatccacctcctcagtctcagcaagagcgaagggtcagcacagaccttcctgagggtcaggatgtgtacactgctgcatgcaactccgtgatccatcggtgtgccctgttaatattaggagtaagtcctgtgatagatgagcttcagaagcgaagagaagaaggacagttgcagcaaccttcaacaagtgcctctgaagggggtggacttatgaccaggagtgaaagtcttactgcagagagccggctagtccacacaagcccaaattatagactgatcaaatcgaggagtgaatctgatttgtctcagcctgaatcagatgaagagggttacgcactgagtggcagacgaaatgttgatttggatttggcagcatctcacagaaagagaggtcctatgcacagtcaattggaatccctgagtgactcttgggctcgcctgaaacatagcagagactggttatgcaactcctcctattcctttgagtcagattttgatcttaccaagtctttgggagttcacactttgattgaaaatgttgtaagctttgtgagtggagatgtggggaatgccccaggttttaaagagccagaggaaagtatgtctacaagtccccaggcctccatcattgcaatggaacagcagcagttaagggcagaacttcgtttagaggcacttcatcagatcctcgttctattgtctgggatggaagaaaaaggtagcatctcactggcaggaagcagattgagttcaggcttccagtcctccacactactcacgtctgtgaggctgcagttcctagcagggtgttttggtttaggcactgttggacacacaggaggcaagggagagagtggccgattgcatcactatcaggatgggatcagagcagctaagagaaatattcagattgaaatccaggtagctgtgcataaaatttatcaacagttgtctgctaccctggaaagagccctgcaagcaaacaagcatcacattgaagcccagcaacgtctgcttctggttacagtttttgccctaagtgttcattatcaaccagtagatgtttctttggcaatttccactggtctgctaaacgtattgtcacagttgtgtggtacagacaccatgctaggacagcccctgcagttgttgccaaagacgggtgtttcccagcttagcacagctttgaaagtggccagtacaaggttgctccagattctagccatcactactgggacctatgctgataaactgagtcccaaagtagttcaatccttgttggatctactctgtagtcagttgaagaatttattgtcccaaactggtgtactacatatggcctctttcggagaaggggagcaagaagacggtgaagaagaagaaaaaaaagttgactccagtggagaaactgagaagaaagatttcagagctgctcttaggaaacaacatgcagccgaactccatctaggggattttttagtttttcttcgcagagttgtatcttcaaaagcaattcaatcaaaaatggcttccccaaagtggaccgaagtgcttctaaatatagcatctcagaaatgttcttcaggtatccctctggttggtaacttaagaacaaggctccttgcacttcatgtccttgaagctgtgctgccagcttgtgaatctggtgtagaagatgatcaaatggcccagattgttgagcgcttattttcccttctctctgattgtatgtgggagacacccattgctcaggccaaacatgctattcagataaaggaaaaagaacaagaaataaaactacagaagcagggcgagttggaagaagaagatgagaatcttcctatccaagaagtatcctttgacccggagaaagctcagtgttgcctagtggagaatggacagattttaactcacggcagtggagggaaaggatatggattggcatctacaggagtaacttctgggtgctatcagtggaagttttatattgtgaaggaaaacagaggtaatgaaggcacgtgtgttggagtttctcgctggccagtacatgactttaatcaccgcactacctcggatatgtggctctatagggcctacagtggtaacctctatcacaatggagaacagactctcacattgtccagctttactcaaggagatttcattacctgtgtgttagacatggaagccaggaccatttcttttgggaaaaatggagaggaacccaaattagcttttgaagatgtggatgcagcagagttgtacccatgtgtgatgttctatagtagcaatccaggggaaaaggtgaaaatttgtgatatgcagatgcgtggcacaccccgagacttacttccaggagaccctatttgtagtccagtagcagcagtgctggctgaggccactattcagctcatccgtatccttcaccgaacagaccgttggacttactgcattaacaaaaaaatgatggaaaggcttcacaaaattaagatatgtattaaagagtcaggtcagaagctaaagaaaagccgctcggttcagagccgagaggaaaatgaaatgagagaggagaaggagagcaaagaggaagagaaaggtaaacatactaggcatggcctcgctgacctctcagagctgcagctgaggactctttgcatagaggtgtggcccgtgctggctgtgataggaggagttgatgctggtcttagagttggaggtcggtgtgttcacaagcaaactgggcgccatgccacgctgctgggagtggtcaaagagggcagcacgtctgccaaggtccaatgggatgaagcagaaattactatcagcttcccaactttttggtcgcctagtgatactccattgtataatctggaaccctgtgaaccattgccgtttgatgtggcgcgattccgaggcctgacggcttctgtgctgctggacctaacatatctcactggcgttcatgaagacatgggcaaacagagcaccaaacgacatgaaaagaaacaccgacatgaatccgaggagaaaggggatgttgagcagaaacctgagagtgaatccgctttagatatgcgaacaggcctaacatctgatgacgtcaaaagtcagagtaccacaagctccaaatcagaaaatgaaatcgcttcattttctttagatccaacactgccaagtgtggaatcccaacatcaaataacagaagggaaaagaaaaaatcatgaacacatgtccaaaaaccatgatgtagcccagtcagaaatcagagcagtccagctgtcctatctttacctcggtgctatgaagtcacttagtgcccttcttggctgtagtaaatatgctgagctgttgctgataccaaaagttctggctgaaaatggccacaactcagactgtgcaagttctccagttgttcatgaagacgtggagatgcgagcagccctgcagttcttgatgcgacacatggtgaagcgagcagtcatgcggtcacccataaagagagcattgggattagctgatctggaacgagcgcaagccatgatctataaattagtggttcatgggcttttggaagaccagtttgggggcaaaattaagcaagagattgatcaacaagctgaagaaagtgaccctgcccagcaggcacagacaccagttactactagcccatcagcctcaagcacgacctcctttatgagcagctctctggaggacaccacaactgccaccactccagtcactgacacagaaacagtgcctgcatccgagtccccgggagtgatgcctcttagtcttctcaggcaaatgttctctagttacccaactaccactgtacttcccacacgtcgggcacagactcctccaatatcttcgttaccaacctctccttctgatgaagtaggaaggaggcaaagtttaacttctcctgattcccagtcagcaaggccagctaaccgcacagccttgtcagacccaagcagtagactttcaacttctcctcctcctccagcaattgcagttcccttgctggaaatggggttctctcttcggcagattgccaaagccatggaagctacaggtgctaggggagaggctgatgcccagaatatcactgtccttgccatgtggatgatagagcaccctgggcatgaggatgaagaggagccccagtcgggcagcacagcagactctaggcctggagcagccgttctaggcagtggcgggaagtcaaatgatccctgttatttgcagtcacctggagacataccatcagctgatgctgctgaaatggaggaaggttttagtgaaagccctgataatttggatcatacagagaatgcagcttctggaagtggaccatcagctagaggtcgctcagcggtaacaagaagacacaagtttgacttagctgctcgcacactgctagcaagagcagcgggattataccgctctgtgcaggcccacaggaatcaaagtcggagagaaggaatatctttgcagcaagacccaggggcgttgtatgactttaatttagatgaggaattggaaattgatcttgatgatgaggcgatggaagctatgtttggacaagacctgaccagtgacaatgatattctgggaatgtggatcccagaggtactggattggcctacctggcatgtttgtgagtctgaagacagggaagaagtggtggtgtgtgaactgtgtgaatgcagcgtcgtcagcttcaatcagcacatgaagagaaaccatccaggctgtgggcgcagtgcaaaccgccagggctatcgcagcaatggttcctatgtggatggctggtttggcggtgaatgtgggagtggaaatccgtactacctgttatgtggcacctgcagggagaagtacttagccatgaagaccaaatctaagtcaacaagttctgaaaggtacaagggacaagctccagatctaattggcaagcaagacagtgtgtatgaagaagactgggacatgttggatgttgatgaagatgaaaagctaactggtgaagaagaatttgaattacttgctggaccgcttggtttaaatgaccggcgcattgtaccagaaccagttcagttccctgacagcgatccactgggagcatcagtagcaatggtcacagccaccaacagtatggaagagactctgatgcaaataggttgccatggctccgtagaaaagagctcctctgggagaataacgttaggagagcaggcagctgccctagcaaaccctcatgaccgtgtggtggctttaaggagagtgactgctgctgctcaggttcttctggccagaaccatggtcatgagagcgctgtctcttctctcagtcagtggttccagttgtagcctggctgctggtcttgagtctctggggctaacagatatccgaacgctagttcgattaatgtgcttggcagcagcagggagagctggcctctccaccagcccttctgccatggctagcacctcagaacgatcacgaggtgggcatagcaaggctaacaagcctatctcttgcctggcctatttgagcacagcagtgggatgtctggcatcaaatgctcctagtgctgccaaactgcttgtacagttgtgtacacagaacttgatttctgctgcaacaggtgtaaatctaaccacagttgatgactcaattcagcgaaagtttctacccagctttctccgaggaattgctgaagagaacaagcttgtgacctccccaaactttgttgtaacacaggcccttgtggcattgctagcagacaaaggggccaaactaagacctaactatgataagtcagaagttgaaaagaaaggccctctggagttggctaatgccctggcagcctgctgcctctcctccaggctgtcctcacagcatcggcaatgggcagctcagcaactcgtgcgcactcttgctgcacacgaccgtgacaaccaaactactctgcagacacttgctgatatgggaggagatcttagaaaatgctcctttatcaaattggaggctcatcagaacagagtaatgacatgtgtttggtgtaataaaaaaggtcttttggctacaagtggcaatgatggcaccatccgcgtatggaatgttaccaagaagcaatattcactgcaacagacctgtgtgttcaacagattggaaggggatgctgaggaaagcctgggatcacccagtgatccaagtttctcaccagtttcctggagtatcagtggcaaatatctagcaggcgctttggaaaagatggtgaatatctggcaagttaatggaggaaaaggattagtagatattcagcctcattgggtatctgccctggcttggccagaagagggtccggctacagcctggtcaggagagtctccagaattgttgttggtgggacggatggatggatctctgggactgattgaagttgttgatgtgtccaccatgcaccgtcgagaattggagcattgctatcgaaaggatgtgtctgttacttgcattgcatggttcagtgaagacagaccatttgcagtgggatattttgatggaaaactgttactgggaacaaaggaaccacttgagaaaggaggcattgttctaattgatgcacataaggatactcttattagcatgaagtgggaccctacaggtcatattcttatgacatgtgccaaagaagacagtgtgaaactctggggctctatttcgggatgctggtgctgtctacattcactctgccatccatctattgtaaatggcattgcttggtgccgccttccagggaaaggatccaagttgcagttactgatggctactggctgtcagagtggcttagtatgtgtttggcgcattcctcaagatactacacagaccaatgtgactagtgcagaaggatggtgggagcaggaatcaaattgccaggatggatataggaaatcatcaggagccaagtgtgtttatcagctgcggggacacatcactcctgttcggactgttgcctttagttctgatgggttggccctggtgtctggtggactaggtgggctcatgaacatttggtctttaagggatggctctgtcttgcaaactgttgtgataggctctggagctattcagaccacagtatggattccagaagttggagtagctgcttgctcaaatagatcaaaggatgttttggtcgtgaattgtacagcagaatgggcagctgccaatcatgttttggcaacctgtaggacagcattgaaacagcagggtgttctgggattgaacatggctccctgcatgagagcatttttggagcggctccccatgatgcttcaggagcagtatgcctatgaaaagcctcatgtggtttgtggtgaccaacttgttcatagcccctatatgcaatgcttggcttcccttgctgtgggacttcatctggatcagctgttgtgtaaccctccagtgccaccacaccaccagaactgtctccctgaccctgcatcctggaatccaaatgaatgggcctggttagaatgtttctcaaccactataaaagctgccgaagccctgaccaatggagcccagtttccagaatcttttaccgttccagatctagaacctgttccagaggatgaacttgtatttctaatggataacagtaaatggattaacggcatggatgaacaaattatgtcttgggcaacttccagacctgaggactggcacctgggaggtaaatgtgatgtctacttatggggtgctggtaggcatggacagctggcagaagctggaagaaatgtaatggtacctgcagcagctccctcattctcacaggcccaacaggtcatttgtggtcagaattgtacctttgtcatccaggccaatggcacagtgttggcttgtggggaaggaagttatggcagattaggacaaggaaattcagatgaccttcatgtgctgacagttatttcagccttacaaggctttgtggtgacccagctggtgacttcctgtggttctgatgggcactctatggccctaactgaaagtggtgaggtctttagctggggagatggtgactatggtaaacttggccatgggaacagcgacaggcagcggcggcccaggcagatcgaggccttacaaggagaagaagtggtgcagatgtcttgtggcttcaagcactcagcagtggtcacttcagatggcaaactgttcacctttgggaatggtgactatggtcgtctgggtcttggaaatacctctaacaaaaaacttccagagagagtgactgcactggagggatatcagattggacaggtggcctgtggattaaaccacactttggcagtgtcagcagatggttccatggtgtgggcttttggagatggagactatggaaaactaggcttaggaaattccactgcaaaatcttcacctcagaaaattgacgtcctttgtggaattggaataaaaaaggttgcttgtggaactcagttttctgttgctttgaccaaagatggtcatgtgtatacctttggtcaagatcgcctgataggcttgccagaggggcgtgctcgcaatcacaatcgaccgcaacaaatccctgtcctggctggagtaatcatagaagatgtggcagttggagctgaacacacacttgctttggcatcaaatggagatgtgtatgcctgggggagcaattcagaagggcagctcggcttaggccataccaaccatgttcgagaaccaaccctggtaacaggtctgcaagggaaaaatgttcggcagatctcggctggccgctgccacagtgctgcatggacagcaccacctgtcccaccaagagcaccaggtgtgtcagtacctctgcagctgggcctgcctgacacagtgcccccccagtatggggcgctgagagaagtcagcattcacacggtgcgggccaggctccggctgctctaccacttctctgacctcatgtactcatcctggagactgctgaaccttagccccaacaaccagaacagcacatcccattataatgctggaacttggggcattgtacagggacaacttcggcctttgttagccccaagagtctacactctgccaatggtgcgctccataggaaaaaccatggttcaaggcaaaaactatggacctcagataactgtaaagaggatatcaaccagaggacggaagtgtaagcctatttttgtccaaatagcgagacaagtagttaagctgaatgcttcagacctccgcctgccttcccgagcgtggaaggttaagctggttggagaaggggctgatgatgctggaggagtgtttgatgacaccatcacagagatgtgccaggaacttgaaactggtattgttgaccttcttataccctctcccaatgccaccgcagaagtgggttacaatagggacaggttcctttttaacccttctgcctgcctcgatgaacacttaatgcagtttaagtttttaggaattttaatgggggttgccattcgcacaaagaagcctctggacctccacttggcccctctggtgtggaagcagctgtgctgtgtcccactcaccctagaggacctggaggaggtggatctgctctacgtgcagactctcaacagcattcttcacattgaagacagtgggattaccgaggagagtttccatgagatgattcctcttgattcttttgttggccagagtgctgatggcaaaatggttcctataatccctggtggaaatagtatcccactcacattttccaacaggaaggaatatgtggagagggccattgaatatcgacttcatgagatggacagacaggtggctgcagtccgagaagggatgtcctggattgttcctgtgccgctgctgtccctcctcacagcaaaacaactggagcagatggtgtgtgggatgcccgagatctctgtggaagtcttgaagaaagtggtgcggtaccgtgaggtggatgagcagcatcagctggtgcagtggttctggcacacgctggaagagttctccaatgaggagcgggtgcttttcatgaggtttgtgtcaggaagatctcgactaccagccaacactgctgacatttctcagagatttcaaatcatgaaggttgataggccttacgacagtctgcctacctcacagacctgcttcttccagctgaggctgcccccgtactccagccagctggtcatggccgagcgcctgcgctatgccatcaacaactgccgctcaatcgacatggacaactacatgctctcgagaaacgtggacaacgccgagggctccgacactgactactgaccgtgcgggtgctctcaccctcccttctctccctcaataatgctcacttctgatttgatgttgatatacttttatggtaactacatagatgttataagaacataaaccaacattataaacaatggccacatttagttactctaaatgtaacaaagaaattagatgtttttatttttctgtgattgtacaaaaacaacaaaaacgaagtgctctcagtcaggtttttccctccatatttttggtcacttttgataagtttgcatgaaaccattttggtgcatttttagttgggaatggtacatttttgtaaatccacccagtgaacatgaaattgtacattgtgtataattgttcattagaaaggacagttttacatgaatattcatatatttattttgttttaatttgaattgcctgttcagggttccttatgcagagaaataaagcagattcaggaattgga

SEQ ID NO: 3366 - DNA, 8082 bp, Homo sapiens
gcagagtctgcagtgcggagggggcgggaagtccaggccccgcactcgatccacgctggctccctacggaggcccacctactcgaggcccaccgactcctactgcaatcagtactatgcgatcgtcctagagagtccattcagctgcacttccgcctcagtatggcatcacagctgcaagtgttttcgcccccatcagtgtcgtcgagtgccttctgcagtgcgaagaaactgaaaatagagccctctggctgggatgtttcaggacagagtagcaacgacaaatattatacccacagcaaaaccctcccagccacacaagggcaagccaactcctctcaccaggtagcaaatttcaacatccctgcttacgaccagggcctcctcctcccagctcctgcagtggagcatattgttgtaacagccgctgatagctcgggcagtgctgctacatcaaccttccaaagcagccagaccctgactcacagaagcaacgtttctttgcttgagccatatcaaaaatgtggattgaaacgaaaaagtgaggaagttgacagcaacggtagtgtgcagatcatagaagaacatccccctctcatgctgcaaaacaggactgtggtgggtgctgctgccacaaccaccactgtgaccacaaagagtagcagttccagcggagaaggggattaccagctggtccagcatgagatcctttgctctatgaccaatagctatgaagtcttggagttcctaggccgggggacatttggacaggtggctaagtgctggaagaggagcaccaaggaaattgtggctattaaaatcttgaagaaccacccctcctatgccagacaaggacagattgaagtgagcatcctttcccgcctaagcagtgaaaatgctgatgagtataattttgtccgttcatacgagtgctttcagcataagaatcacacctgccttgtttttgaaatgttggagcagaacttatatgattttctaaagcaaaacaaatttagcccactgccactcaagtacatcagaccaatcttgcagcaggtggccacagccttgatgaagctcaagagtcttggtctgatccacgctgaccttaagcctgaaaacatcatgctggttgatccagttcgccagccctaccgagtgaaggtcattgactttggttctgctagtcacgtttccaaagctgtgtgctcaacctacttacagtcacgttactacagagctcctgaaattattcttgggttaccattttgtgaagctattgatatgtggtcactgggctgtgtgatagctgagctgttcctgggatggcctctttatcctggtgcttcagaatatgatcagattcgttatatttcacaaacacaaggcttgccagctgaatatcttctcagtgccggaacaaaaacaaccaggtttttcaacagagatcctaatttggggtacccactgtggaggcttaagacacctgaagaacatgaactggagactggaataaaatcaaaagaagctcggaagtacatttttaattgcttagatgacatggctcaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcatgttaagtcttgttttcagaacatggagatctgcaagcggagggttcacatgtatgatacagtgagtcagatcaagagtcccttcactacacatgttgccccaaatacaagcacaaatctaaccatgagcttcagcaatcagctcaatacagtgcacaatcaggccagtgttctagcttccagttctactgcagcagctgctactctttctctggctaattcagatgtctcactactaaactaccagtcagctttgtacccatcatctgctgcaccagttcctggagttgcccagcagggtgtttccttgcagcctggaaccacccagatttgcactcagacagatccattccaacagacatttatagtatgtccacctgcgtttcaaactggactacaagcaacaacaaagcattctggattccctgtgaggatggataatgctgtaccgattgtaccccaggcaccagctgctcagccactacagattcagtcaggagttctcacgcagggaagctgtacaccactaatggtagcaactctccaccctcaagtagccaccatcacaccgcagtatgcggtgccctttactctgagctgcgcagccggccggccggcgctggttgaacagactgccgctgtactgcaggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaagtgaagcccctctttatttcattttgtgttattgtgattgctggtcaggaaaaatgctgatagaaggagttgaaatctgatgacaaaaaaagaaaaattactttttgtttgtttataaactcagacttgcctattttattttaaaagcggcttacacaatctcccttttgtttattggacatttaaacttacagagtttcagttttgttttaatgtcatattatacttaatgggcaattgttatttttgcaaaactggttacgtattactctgtgttactattgagattctctcaattgctcctgtgtttgttataaagtagtgtttaaaaggcagctcaccatttgctggtaacttaatgtgagagaatccatatctgcgtgaaaacaccaagtattctttttaaatgaagcaccatgaattcttttttaaattattttttaaaagtctttctctctctgattcagcttaaatttttttatcgaaaaagccattaaggtggttattattacatggtggtggtggttttattatatgcaaaatctctgtctattatgagatactggcattgatgagctttgcctaaagattagtatgaattttcagtaatacacctctgttttgctcatctctcccttctgttttatgtgatttgtttggggagaaagctaaaaaaacctgaaaccagataagaacatttcttgtgtatagcttttatacttcaaagtagcttcctttgtatgccagcagcaaattgaatgctctcttattaagacttatataataagtgcatgtaggaattgcaaaaaatattttaaaaatttattactgaatttaaaaatattttagaagttttgtaatggtggtgttttaatattttacataattaaatatgtacatattgattagaaaaatataacaagcaatttttcctgctaacccaaaatgttatttgtaatcaaatgtgtagtgattacacttgaattgtgtacttagtgtgtatgtgatcctccagtgttatcccggagatggattgatgtctccattgtatttaaaccaaaatgaactgatacttgttggaatgtatgtgaactaattgcaattatattagagcatattactgtagtgctgaatgagcaggggcattgcctgcaaggagaggagacccttggaattgttttgcacaggtgtgtctggtgaggagtttttcagtgtgtgtctcttccttccctttcttcctccttcccttattgtagtgccttatatgataatgtagtggttaatagagtttacagtgagcttgccttaggatggaccagcaagcccccgtggaccctaagttgttcaccgggatttatcagaacaggattagtagctgtattgtgtaatgcattgttctcagtttccctgccaacattgaaaaataaaaacagcagcttttctcctttaccaccacctctacccctttccattttggattctcggctgagttctcacagaagcattttccccatgtggctctctcactgtgcgttgctaccttgcttctgtgagaattcaggaagcaggtgagaggagtcaagccaatattaaatatgcattcttttaaagtatgtgcaatcacttttagaatgaatttttttttccttttcccatgtggcagtccttcctgcacatagttgacattcctagtaaaatatttgcttgttgaaaaaaacatgttaacagatgtgtttataccaaagagcctgttgtattgcttaccatgtccccatactatgaggagaagttttgtggtgccgctggtgacaaggaactcacagaaaggtttcttagctggtgaagaatatagagaaggaaccaaagcctgttgagtcattgaggcttttgaggtttcttttttaacagcttgtatagtcttggggcccttcaagctgtgaaattgtccttgtactctcagctcctgcatggatctgggtcaagtagaaggtactggggatggggacattcctgcccataaaggatttggggaaagaagattaatcctaaaatacaggtgtgttccatctgaattgaaaatgatatatttgagatataattttaggactggttctgtgtagatagagatggtgtcaaggaggtgcaggatggagatgggagatttcatggagcctggtcagccagctctgtaccaggttgaacaccgaggagctgtcaaagtatttggagtttcttcattgtaaggagtaagggcttccaagatggggcaggtagtccgtacagcctaccaggaacatgttgtgttttctttattttttaaaatcattatattgagttgtgttttcagcactatattggtcaagatagccaagcagtttgtataatttctgtcactagtgtcatacagttttctggtcaacatgtgtgatctttgtgtctcctttttgccaagcacattctgattttcttgttggaacacaggtctagtttctaaaggacaaattttttgttccttgtcttttttctgtaagggacaagatttgttgtttttgtaagaaatgagatgcaggaaagaaaaccaaatcccattcctgcaccccagtccaataagcagataccacttaagataggagtctaaactccacagaaaaggataataccaagagcttgtattgttaccttagtcacttgcctagcagtgtgtggctttaaaaactagagatttttcagtcttagtctgcaaactggcatttccgattttccagcataaaaatccacctgtgtctgctgaatgtgtatgtatgtgctcactgtggctttagattctgtccctggggttagccctgttggccctgacaggaagggaggaagcctggtgaatttagtgagcagctggcctgggtcacagtgacctgacctcaaaccagcttaaggctttaagtcctctctcagaacttggcatttccaacttcttcctttccgggtgagagaagaagcggagaagggttcagtgtagccactctgggctcatagggacacttggtcactccagagtttttaatagctcccaggaggtgatattattttcagtgctcagctgaaataccaaccccaggaataagaactccatttcaaacagttctggccattctgagcctgcttttgtgattgctcatccattgtcctccactagaggggctaagcttgactgcccttagccaggcaagcacagtaatgtgtgttttgttcagcattattatgcaaaaattcactagttgagatggtttgttttaggataggaaatgaaattgcctctcagtgacaggagtggcccgagcctgcttcctattttgattttttttttttttaactgatagatggtgcagcatgtctacatggttgtttgttgctaaactttatataatgtgtggtttcaattcagcttgaaaaataatctcactacatgtagcagtacattatatgtacattatatgtaatgttagtatttctgctttgaatccttgatattgcaatggaattcctactttattaaatgtatttgatatgctagttattgtgtgcgatttaaactttttttgctttctccctttttttggttgtgcgctttcttttacaacaagcctctagaaacagatagtttctgagaattactgagctatgtttgtaatgcagatgtacttagggagtatgtaaaataatcattttaacaaaagaaatagatatttaaaatttaatactaactatgggaaaagggtccattgtgtaaaacatagtttatctttggattcaatgtttgtctttggttttacaaagtagcttgtattttcagtattttctacataatatggtaaaatgtagagcaattgcaatgcatcaataaaatgggtaaattttctga

SEQ ID NO: 3367 - DNA, 2391 bp, Homo sapiens
gtccctctctggccaccgcacgacgggcgcagaaatctgggccccagagctgcgctgagagatcccccgacgcttccccagcctcccagggaggccttcgcggagtcggggcgtcgcgggtcggggcgctcgctgtgtcccttcagctccagactgcgtgaagctcctccagcaggccccagcgcccagggattttgtcctaaaaaagggtcatggagtgggtggattgcgggcggcccggcgctttttctgcatacggatttcgtcccaaatttgctaacatgagaaccacagtttttcagaagagcagaatgtttatttgccaagacctgtttggcaggtgtgaatgttttagagaagaaatgccgagaaaatgctggcattttgcgttgcgggtttttttttaaattgagaaataggttactggcttactttgtttctccagaatattttcacttggctttaatttaagtcatgtggctttaatttccttccagattatgcgttcagatgtggcaaaggcttaagagaatcattatctcttaatcgtagcggttttgattatcttttttcccacatcatatttttctttctttctttttaaatcacagctttacgtttttaagagtctctatctggttcattgattgattcaacaaatatttattaagtgtctaatatgtgccaggcatagttgctggggatgcagcaggaaacaacgcagaatttttggccttcttggaaatgggcagtaagcagaatgatatcctgagagaagatgggaaagggctgcaaggttgtggtttgtggattgttatctgtggggaaaactgcaattttggagcagctcctttatggaaatcatactattggaatggaagattgcgaaacaatggaagatgtatacatggcttcagtagaaacagaccgaggagtaaaagaacagttacatctttatgacaccagaggtctacaggaaggcgtggagctgccaaagcattatttttcatttgctgatggcttcgttcttgtgtacagtgtgaataaccttgaatcctttcaaagagtggagcttctgaagaaagaaatcgataagttcaaagacaaaaaagaggtagcaattgtggtattaggaaacaaaatcgacctttctgagcagagacaagtggacgctgaagtggcacagcagtgggcaaaaagtgagaaagtaagactgtgggaggtgactgttacagatcggaaaactctgattgaaccattcactttattagccagtaaactttctcaaccccagagcaaatcaagctttcctttgcctgggaggaaaaacaaagggaactctaattctgagaactaaaaatcagtaatttccacaattgtatgttgaatagtgattgcctttaagtgtctgtgaacatggagtaatattactatttaaaataggccatttgtatctacctttggtccttaggaaaattcctaaggaagtcaattaatgcactttagatgttaaaagtatttgggctaaggttattattgcctgatatgaaataatatattcttattctcattgtttgaaacctgtctttgaaattagcacctttgttatttatgttgtacttgtgaaaacagtaaaatagtttggatagttatgcaaatgcacctatgtgtaacttccccccaaccccaagctgtttcggaagatatcataatcattctgtgtaacattatgcaaacttctaagcccaaacatgactttgtttttaaaaagttcattaatctaatgtctaggattataaaacatttttttgtgtctaaattggacccaaaacattgaacagtttggggtagtaagctaaatttcatcttgtggagattttgctaaacagactaagacccatgatttagctttgctcaaattagaatgtttagcatgagttgaggtaccaggtagtgttaagtaggttcatcacgctctaaggccgttttttccttagccagacccctgttgatagaccagatacttgagggcaaactgtttgctcctcctcttgaaaatgattaggcacttaaggacagtaaagctgtattttctggaaggaagactgtatcttctggaatagttttctagaaaactagtcatatacaataaaagtatcaaaaatattgggctctaatttgatctgacttagatgtctgagtttgtgttgtttctctaaagattttggcaagactcaagcaatgtggctgactgtaactttattaatttaaaaggtaggaagtaagctacttagtggtttcacctgtgaaataactattttgactgaaatgtaaaataagctattcaacaaagaacatattaaaacatcaagtaatttgtaacatcttaaa

SEQ ID NO: 3368 - DNA, 2163 bp, Homo sapiens
gacgccgatgcggagctgagctggctttcctccagggctctggactccctgctgagcaagagagaaagaggcccgcccttccaccaggacgcctgaccctggggtccttcccaaacccgggtctcttccgactccgggcccaacagtttgtgcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagaagtaaaataagtgaacttacaactgaagttaataaacttcagaagggaatagaaatgtacaatcaagagaattcagtatatttgtcatatgaaaagagggctgagactttagctgttgagataaaagagcttcaaggacaactagcagactacaacatgttggtagataaacttaataccaacactgaaatggaagaagtaatgaatgattacaatatgcttaaagctcaaaatgatcgagaaacacaaagtttggatgtcatatttactgaaagacaagcgaaagaaaaacaaatcagaagtgtcgaagaagaaattgaacaggaaaaacaagcaacagatgacattatcaaaaatatgtcttttgaaaaccaagtcaagtacctagagatgaaaaccacaaatgagaaactgttacaggaattagatacacttcaacaacaattggattcacagaacatgaaaaaagagagcctggaagcagaaatagctcactcccaggtgaaacaggaggcggtattgctgcatgaaaaactttatgagttggagtcccatcgagatcaaatgattgcagaagacaaaagcataggatctccaatggaagagagagagaaattacttaagcagattaaagatgataatcaggaaatagccagcatggaaagacagttaacagatacaaaagaaaagataaatcagtttattgaagaaattagacaacttgacatggatttagaggaacaccaaggtgaaatgaaccagaaatacaaggagctaaagaaaagggaggaacatatggacacttttattgagacttttgaggaaacaaagaatcaggaactgaaacgaaaggcacagatagaagccaacattgttgcactcttggagcactgcagtcgaaatataaatcgtatagaacagatatcctctatcaccaatcaagagctaaagatgatgcaggatgacctcaattttaaatctactgaagtgcagaaatcacaaagtacagctcagaatttgacttcagacattcaacgtctgcagttggatctgcagaaaatggagcttctagaaagtaagatgactgaagaacagcattctctaaaaagcaaaattaagcaaatgacaactgatctggagatatataatgatttgccagctttaaaatcatcaggtgaagaaaagataaagaaattacatcaggagagaatgatattatcaacccacagaaatgcctttaagaaaataatggagaagcaaaacatagagtatgaggcactaaaaacacaattgcaagaaaatgagacacattctcagcttacaaatttggagagaaagtggcaacaccttgagcaaaataattttgcgatgaaagaattcatagcaaccaagagtcaagagagtgattaccagccaattaagaaaaatgtgaccaagcagattgcagagtacaataaaaccatcgtggatgctttacatagcaccagcggaaactgagtttaagtccactgaaagtctctaaggaagtatcctcttgctgctaaacttggtacaagttgactaccaaaaaaaaaaaaagcttacttttggagtttacctaaaatttctgaatgttataatttttgtggcctcttttaagaatgatattttaaaatagtaaatagttcaataaatggtttgcatatt

SEQ ID NO: 3369 - DNA, 1647 bp, Homo sapiens
atgctgctgctgccgggtgtccatggcccgcacccccaagctgccactgcagcagtcagagtggcagctgaaggctcggttcatgccgtgcccccgggcagttctggtgaggctaagcaagaggcctctgcatcttgacacctaggagagcagggacggagtctcccagggtggaggaccatgctgcgccgcaagccctccaatgccagtgagaaggagtttaatctggatgataacattccagaagatgactcaggtgtccccaccccagaagatgctgggaagagtggcaaaaagctggggaagaagtggagggcagtgatttcccgaaccatgaacaggaagatgggcaagatgatggtgaaggccctgtcagaagagatggcagacactctggaggagggctctgcctccccgacatctccagactacagcctggacagccctggccctgagaagatggcgctggccttttctgagcaagaggagcatgaacttccggtgctcagccgccaggcatcaacaggcagtgagctctgcagccccagcccaggttctggcagcttcggggaggaaccacctgccccccagtacacagggcctttctgtggccgggcacgagtccacaccgacttcactcccagcccctatgaccacgactcgctgaaactgcaggtaagatcagcatccgggcttctctggagcctggcaggctgtgcccaaaaaggaagctggactgaaccaggctatgacagtgtcagtggaggccaaggccccccatatcctctctcccttgctcccttctcctctcctctcccccaacagaaaggagatgtgatccagatcattgaaaagccacctgtgggcacgtggctgggcctactcaatggcaaggtgggctctttcaaattcatctatgtggatgtgctgcccgaggaggccgtggggcatgcccgccccagccgccgacagagcaagggcaagaggcccaagcctaagaccctgcatgagctgctggagcgcatcggcctggaggagcacacatccaccctcctgctcaatggctaccagacactggaagacttcaaagagctgcgagaaacacacctcaatgagctgaacatcatggatccacagcaccgggccaagctgctcacggccgccgagctgctgctggactatgacactggcagtgaggaggctgaagagggcgccgagagcagccaggagccagtggcacacacagtgtcggaacccaaggtggacatcccgcgcgactcaggctgctttgagggctcggagagcgggcgcgatgacgcagagctggcaggcactgaggagcagctgcaaggcctctccctggccggggcaccttgaggtggcggtggcaataggccaaggctgggacccagctgcaaaggctgtaggagtggggtttatcgaggggaccagaggggcctcaggctttcagatgaaatggctcctcctactcacccactttattcctctccatgtaattcaggacaagctgcaacttcccccagcttaacacaatgcccatacctcatacgatatgcgccctcccgttccatccctggccccctcaaacgagacttctcacaaggctgattacagatggtcaaacct

SEQ ID NO: 3370 - DNA, 1521 bp, Homo sapiens
gttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcaggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgggttccaggctgtggttataaggccagtatgagcagatggtattaagcacctgccatgtgcaccatgctatcttcactgagatttgccagcaggatgaagctagtcaccactgagcctgccatcaatgaaaagtatgatgctgaggaatggccaggatgtctgggcacagaatgaggaattgtacttttgctgtggaagagacagggtagcttctctgatgatccttcctgtcggcccccaccctaccatgtttcccggcagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgag

SEQ ID NO: 3371 - DNA, 2755 bp, Homo sapiens
cgccgctcgctccgccccccgcccggaagctcccgcccgagcccgcgcaggccctggggccgaccttcctgccgggccgggcggtccgaggctgctggagtgccgtgagcaggccgcgggaacgtcgccgtcaccttgtctcggggcctcggcgctgcttcccgccaaaacacgtttaccgcgcgcccgggcctcccaccttgcggaagggaccccaccaccacttggatttctgttgcaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaactttt

SEQ ID NO: 3372 - DNA, 3678 bp, Homo sapiens
aatctctactcggcccgcaccagcagcgctggcgtcagggcgcggtgggggcaagacgggtgactggcagcagggcggtgccgggccgagaagggcgcctcacctggcgcctcctgccttcctttccacctcaggttgcagagagccgccagggcaggtggaagggccacgccccgctcccgtgagggtcaccgagagacgttgggggtggggcagggaccccaaccctagaccagtcctgtagggcacaatgtctgaacaagagcgtatacaggaatgtctgcggaaggaaataaggtcacttctcatttccaccaaagatggtttgagcccacaggagttggagaaggagtaccttttgatggttggcaaccatctaccactccgaatccttgggtatcggtccactatggagctggtattggacatgcctgatgttgttcgtgtctgccccggtgcaggtggtactgtaatactgaaagccattccagatgaatctaccaaaggaatagcaagcttagttgcaaaacagaggagcagccataagcttcgaaactcaatgcataagggaagacctagtatttattctggaccgagatctcatcggcgagtaccttaccgaggaagggttgcccctattcttccagctgttgtgaagagtgagttgaaggacctgttggcgttatctcctgttcttctttctgattttgaaaaggcatttgccaaaagatttggacgatcattccaatacatgcaatatggatttctctctatgtttgaagtgcttaatgcggcttcagatgtcatttctgtagagcagaccagagcaggttctttgttgatgctaaagaagagtgtaacagaggaaaagccgagaggatgtccagcaggtaaaatttttacccagccatttagaatgaaacaagggtcatactccacaggctttccggtagcaaagccatgcttttcacaacccacttcaaacatggaaccaccgaagcaaataatgagcatggaaaagacttccaagttaaatgtagtggagacttcaagactgaatcacactgaaaaattaaaccagctggagaacacattcaaatcagttattgcacagattggacctggaggaactatcagttcagaactaaaacataagataaaatttgttgtatctaagttcccagagggtttgtttatttctaaactgcttggagagtatgaggtaatttttaaagagcaactatcaccaaaaaaattaggcttcttaaatgtgacagaacttgttggagctcttagtgacattctccatgttgagttcaggaaaggacaccaagacttactagtgtttgatgcggataagaagcctctaccacctgttcagtcagataagaaaatagaagccaaagcttgtgtctccagtccacctagaaattcattgtctactgctgctgtcaaagagactgtatggaattgcccttcaaaaaaacaaaaagagccacaacagaagatttgcaagaagcctaatctggtggtaaagcctttacagctgcaagtagaaacaaacaaatcagagctcaacttggcaatggcaaatcatgacatcccgccagacgctgtgccgaacaagaaattatgcagactcccaccattagacaccagttccctcataggggtctttgtggagtatatcatctctcctagtcaattctacatccggatctatagcagggattcgtcagagttactcgaagacatgatgattgaaatgcggcgctgttattctaatcagctggtttctgatcgatatgtcatgccagaatgttttattcagccgggacatctctgttgtgtaaggatttctgaggataagtggtggtatcgggtcattatccatcgagtccttgagaaacaggaagttgaagtgttctacccagactttggaaatattggaattgttcagaagtcctccctgaggttcctcaagtgctgctacacaaagcttccagctcaggctatcccttgttctttggcttgggtgagaccagtagaggaacactggacatcgaaagctattttgcagttccagaagttgtgcggtttgaagccattagtgggggtagtggatgaatatgtagatggaatccttaacatttttttgtgtgacacatcctcaaacgaagatgtctatttccatcatgtcttgagaacagagggccatgctattgtatgccgagaaaatatctcttctaagggtttcagtgagctcaaccctttagctttatacacgacatccagtggagggccagaggacattgtcttgacagaactgggttatccttcccagcagcactattttaatgaagaccgaaagataagtccacagtcaaaagagagtgagttacgtatcttgcaagatattaatgatgaaaagtctttaagtcatcttaaatctgagtcaaaggagccattaaaggattctgaatttgagtctttgaaaacctgtaataagagctttgaagaagatccaaagtggtccaacccagaaccaaacgatctgaaggaagaaaatgaggatgagatccccactggaatgccatgcctggagtcagtgaccataggtgatgatatttgggatgagaactggttacctctacaggctaagatgggaaaaggaggtgatgctgcctcccatctatttactgcaagccttggtggaaagaatcagtattcatcatgtaaagaaatgccacagaaggactggtgtttttctacccctaaagatacatgggatgattcttggcagccttcaggccttgtaaatggaacgaaagtagaagttcataagccagaagtactgggtgctcaggaaaaaaatactggcacaaacaggactcaaaagcaactagacataaatggttcttcagattcttccacactgcccaaattggaagaattctgtacctctcttacccagtcagagcagtcagcagacgggagccagtctgaacccaacaacagtcagactcagccaaagcaaattcagctttccacagcagcaccctgttcaacaactgcagtggatgattccgcagaaaagccctctggttctgtggaaagctcaccagagatcctaaagaatgaagatttttctagcagccgtgctattacattgtacaaagacaagcgtcaagaatctgtagaccagctgtctttgattttgtcttatgagtgccagatttctcagaagctctacattcctcgaagtacagccactgctgccttaggtgctgccgcacggttagctacatccaggagcctcctacactggtaccccagtgtgaaaaggatggaagcatgagggagggagggaggagggagaaaaacagaatccagccgcttaggctttgatgaactcccaggccaaaatgaggagttattgaagcaaaatagtatcttgatcattgatacttttgtctttctgtgactatatgttagctttattatgctaacagtctactttgatgtgtaagtaagtattgatatttactgttaatcttgatttttcttgattttattctgtgtcattttgttcacctttgtttttaatgtagtttaaaggaatttgtttttttgtgtttgtttttcttgtacattatcatgactgataaatgaaaattg

SEQ ID NO: 3373 - DNA, 1204 bp, Homo sapiens
gagacggaagtttacgacgcccagagcgctccttctggacgtgccctggactcgacttgggactgagtctgtgccgcctaggctggcagggactcggccagatgcactagcggcaaggctgggctgacaccgcctgggactcgctcgccgtacctccaaggggcccaggtcatgagggggcggctggggagacgcccgcccggtgcccgccctgggcccggcgggtgccccctgcccgccgcctgacgcaatccgaggcgcccttgctgcatgccggcgctggagaaacctcccctgccgttgcatcactcctgccaggtttgccacagaggtggagctgaaccaatcagcgggcgcgctgggcccgcggcgcggttaagtgagaagcagaatccgaagttgattggccaaaaggggatttgccccaccccaatcaccgcggcagctggccgcggtgggcgtggtctcccggcaagaaggtttaaagggcgcctccatggggggcgctcagctggagctaccgagcggtgccaggccaggtgtgtgcgtccgtcggtctttccgtgcccacgccggagaccagccccggaggccgcctgggcctatccctgtgccaggcaccatgaagcaggagtctgcagccccgaacaccccgcccacctcgcagtcccctacgccgtccgctcagttcccccgaaacgacggcgaccctcaagcgctgtggattttcgggtacggctccctggtgtggaggcccgacttcgcctacagcgacagccgtgtgggcttcgtgcgcggctacagccgccgtttctggcagggagacaccttccatcggggcagcgacaagatgcctggccgtgtggtgacgctccttgaagatcatgagggctgcacttggggcgtggcataccaagtgcaaggggagcagaaccctggttacctgggccctgcgcctgaagaggccattgccacgcagatcctggcctgccggggcttctccggccacaaccttgaatacttgctgcgtctggcagacttcatgcagctctgtgggcctcaggcgcaggacgagcacctggcagccatcgtggacgctgtgggcaccatgttgccctgcttctgccccaccgagcaggctctggcgctggtgtgaggggctgagcccctgcggggagtgctcatgtggacatcagggccagac

SEQ ID NO: 3374 - DNA, 3182 bp, Homo sapiens
aatgtttatgcatagaaatatagctgaggtggatgtggttgctgtcagctattcaggtttgctacctgatcacctcctgaagatgtagggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggaatcaattcatttacagctttccagtttttccagcctgcaagaggaggataaatctaggaaagatgactctgaaagagaaaaagaaaaggataaaaacaaagataaaacctctgaaaaacccaagatcagaatgttatcaaaagattgcagccaagaatacacggattctacaggcatagacttacacgagtttctgattaacacattaaagaataattccagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaataccagagcaaaggttttgtgaacatttaaaagatgaaaaaggtgaagaatcccagaagcggtttatcttgaagcgagataactctagtattgataaagaagacaatcagtcagtttgctcccaggaaagcctttttgtggaaaacaggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggccagccctttgtgaatcccgatggaactcctgcaatatacaacccacccaccagtcagcagcccctgcgaagcgccatggtggggcagtcccaacagcagccaccacagcagcagccctccccgcagccccaacagcaggtccagccaccgcagccacagatggcaggccctctggtcactcagtctgtccaggggctgcaggcttcctcccagtcagtgcaatatccagcagtctcttttcctccccagcacctcctacctgtgtctccaacgcagcactttcccatgagagatgatgtggcaacacagtttggccagatgaccctgagccggcagtcctcgggggagactcctgaacccccatcaggtcctgtctacccatcctcccttatgccacagccggcccagcagcccagctatgtaatcgcctctacaggccagcagcttcctacaggaggattctcaggctctggccctcccatctcccagcaggtcctccagccccctccctcaccacagggatttgtgcaacagcctccgcctgcacagatgcctgtatattattacccatctggtcagtaccctacctcaaccacgcaacagtaccggcccatggccccggttcagtacaacgctcagaggagtcaacagatgccacaggcagcacagcaagcaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacattatagagttttcttttttaatggatatatactgtattgtagtgtttaatcaaaataaaactatttgacct

SEQ ID NO: 3375 - DNA, 2853 bp, Homo sapiens; identical to SEQ ID NO: 3269

SEQ ID NO: 3376 - DNA, 2233 bp, Homo sapiens
cgcaggtcccgcccctctcgtagcctcgccccgcccgccgcgcaggcgccgtccgagggctccgtttgaaacatggcgcgggctggccctcggctggtgctgagcgaggaggcggttcgggcgaagagcggcttagggcctcaccgcgacctggctgagcttcagtcattgtctattcctggaacttaccaagagaagatcacccacctgggacattctctgatgagtttaacaggtctgaaatctttggatctctcgcgcaactccttggttagtctggagggcattcagtacctgactgcattggagagtctcaatctctactacaactgcatctcctcgttggcagaagtgtttcggctccacgccttaaccgagctcgtggatgtggacttccggctgaaccccgtggtgaaggttgagcctgactaccgcctttttgttgtgcacctgctccccaagctccagcagctggacgatcgccccgtgagagcaagcgagcggaaggcttcccgactgcattttgcatcagaggactcactcgactccaaagagagcgtcccagcttctttgaaagagggcagaatccagacatctgttgagcccgcagttggtacagtaccagtgtggggactctgggaagcagggccgtgagacgaggaggagcagctgcagagggtgctgtctggagaagatgccttggagccagctctgtggagagcttccgccactgtacggagcggagccagaggcctcccgtgcccccaggccacacacgtacttcaccccacacccagactccatggataccgaggactcggcctcttctcagaagttggatttgtcaggagaaatggtgcctggtcccctgccagcccccggaaagtgcaggaagcgaagaatgcctgttggaagattccagacgttttcggaccaggagggtttgggctgcccggagagaactcatgggtcctccgtgcccaaggagagcctgagcagacaggacagctcagaaagcaggaacgggaggaccttgtctcagcctgaggcctcggagactgaggagcagaggtctcggggtgtgaccgacaccagagagccgtctcccgggtcacactcggctctacccgggaagaagacggccctgcaggcggcgctcctggagacgctcttggacctggtggacaggagctggggcggctgcaggtccctgcacagcaacgaggcattccttgctcaggcaagacacatcttgtcatctgttgaagaattcacagcagctcaggacagctctgcgatggtgggtgaagatgtcggctccctggctctggagagtaagtccctgcaaagccgccttgctgagcagcagcagcagcacgcccgggagatgagcgaggtgacggcggagctgcaccacacacacaaggagctggatgatttgagacaacatttagataaatctttggaagagaacagtaggttaaaatcgcttttgttgagtatgaaaaaggaagtgaagagtgcagacactgcagccacgttaaatttgcagatcgctggacttcaaacaagtgtgaagaggctgtgtggcgagattgtggaactgaagcagcacctggagcactacgacaagatccaggagctcacgcagatgctgcaggagagccacagctccctggtcagcaccaatgaacacctgctgcaggagctgagccaggtgcgggcgcagcacagagccgaggtggagcagatgcactggagctaccaggagctcaagaagaccatggccctgtttccacacagcagcgccagccatggaggctgccaggcctgctgactcctgccgagaagctgggccaccccttaagcttcctggtaaagttacattgtctgcacctttgtacttctttattgagtgtactggctggcaagagttctctcttctgttggtaattatttaggatttttggaatgtattcaggacctgtagcttggttttctaaagcacctcgtaaaatgatatgattactccaagccctctgcatgttttcagacagaacacattgacatattttgagacaaactgactattaatcttgtatccagtatcctgagatgaagtaaatgcagtgttctactgcctgatgtgaaagagagctatgtatgataattaaagaaaataattttctgtgtaacaagcaatctttatttaataaacaaatacattgttctg

SEQ ID NO: 3377 - DNA, 253 bp, Homo sapiens
ttctcatctcctgacactatgtatttcaattacaaaagtgtgtgtgggagctgtggatttggctcttgctatggttgtgggtatggctgtatacacagcacccactgtggctgtaacggttattatggttgttatgaaaataaatattctgttatagatgatctgatattttttgcttctaagaaatgccattgagcattgtttcttatttagtttctcaaagatctgttctgctttaatcaccttcaatcct

SEQ ID NO: 3378 - DNA, 1756 bp, Homo sapiens
tcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgcaacagccctcatcttccttgattttatggttttattgtttgtaatttattgatttatttttaagctagttataatcatgtaggtataggaaataaagtcatctataatatttctataatatggctataatatggctataaatctataatatggctggaggcagtgggcagtggttcatgcctgtaatcccagcactttgggaggccgaagtgggaggattgcatgagtccaggagtttgagaccagcctgggcaacaaagcgagaccctgtctttacaaaaaaataaaaattagctggcgatggtgtcgtgtgcctgtagtcctagttacttaagaggctgagttgggaggatcagttgaacccagtggttctgggttgcagtgagctgtggtcacaccactgaactccagcctgtgcgactgagtgagaccctgtgtctaaaaaaataaaaatataatgaatgtgatttatgtagataaattgataatatagtaaataggtaaatgccttaaaaagcatttttaaagaatttgtaaatt

SEQ ID NO: 3379 - DNA, 5940 bp, Homo sapiens
aggacgttgcgtgctcgctcgcgccaggcgagtctccgcgtctccctcgcgaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaggaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgacttcagtctagcgtttccttggtgtttttaggttgctttggtaagtttaggtttgctatatttctgattgcttagaattttgttttagccctttaaaatcagatcataaatatgaattcatacttctaaggaattttcttgctataagctggagtttaggtgatgtataggttcagttgagacatttttggaacaggcaaatccttagttaacataagatatttaacagttgaagatagtgtcatggatttttatcttttttagcaagtaatgctaagaaccactggcctgagctactactcttcagtatacattattaggattgcatagacttactagaggaacagtttcaggttttgatgctaatcagtgttgtgtcctaaagttgtcctttgtgcctttaaaaagttttggatatatcttctagtttaaaattgcttattaaggaattcattttataattgcagtgggaaagtaatggtcaagtaacactaggtagactatcatgcctgtttagcccagagaatttggggggagagagaatagataaaaatggcacccagaaaaatgttaaaatctttagtcaagactagaattaatacaattgtctacacttgtatggcagaaataaccttataaagtgtttaaggaattcagagaagggaatgtaccaaataagcaacagggagaaaattaggtaagaagtaagatacgaacgagaaacctgatttattgctcatccttcccttgcctccctaatggcaagcaaaactctgaacatctgaaaaggatgtagttctggacaaatcctgactacccagaggaaactcactgtgagattgctgttgatttgaagggtgctttcactaaggttatattttaaagtagaataacacatgctgagtgtaaactggctttggattggtcagctgcagtagtacaaaaacagcatagaatttgagaaaactaaaactgctatgagatagctatgagaaaactaaaactgctatgagatagaaatgatgtaaaattatgtggaaagttttccctcatatactcacatacagcctttgaagggctctggctctgaccggttgatggccttgagcgagatgaaatcatgaaattgagtcaaatcaatttgacattgaaatgacaagaggaaactcttaaatacataaaaacaagctctcatttgcctaggatagatactgtcttaaaaataaagactgaacctagatgttctgagcactagcaacaaggtattttaacaagtttaaaggaattctctgaaaaagttataaaattattctaggaaacataaccataatagtgttttaagggactttcacctggggattttatattcatgaacagagtgtattctgtatttaaaatgtctcatttgtgggaattggatgacatgttttttgataaatttattcacaatataaattgactttttattctaggaccatgtgaataatgggttccattgcacaaatacaaatattttaatagcttcttaggcagtggtgtagacatcttggatataaataattgtagatcttgtatatttgatttttaaaaaactagaataaacagagaggcataaacatatcttagagtccaagtggtagtgtttagcattggatataataaatggatgttttacaaagtg

SEQ ID NO: 3380 - DNA, 2758 bp, Homo sapiens
gagcgaggagccgggagcggggaacagggagtcggggagccgggaaccagggctggcagcggccgccatgagcacggtggaccttgctcgcgtgggcgcgtgcatcctgaagcatgcggtgaccggggaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggctctggacccaggcttctccggagtttggccaagcgacctggtgtcttcgcaggtacaacagcctgagcatcctcccagcagctctggggaagcccgtgcgtgatgtggctgccaaggccaaggctgttggcatccaggggaacttgtctggggacctgctgcagagcggagggctgctggtggtcagcaaaggtggtgataaagtgctcctgcatttcgtccagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttgagcc

SEQ ID NO: 3381 - DNA, 2506 bp, Homo sapiens
gagccgggcgtcggaggccctgaggccggccgcagagcccggagattgagcggctttggggaaggggtggttaaggaagtaggcctcggcttccgtcggtcgctgctcggctctgcggcccgtttggaccgcggaggaggtcgccttcccctcccgtggggcgctcggttggactgtggaaaccggggcaacttcccccgtcttcccggctgaggcgcctgcgtgggcctcgcgacccggctcgccaacccgcctcggcccgcacgcccacctcgcctgcggaccccggaggtgcctacgcggactagtgacgccccccgcccgtcggcaactccacccggcgctgaccccctcaactctgcaggacccggcgcgcgaggaccccacgacccgcgggcgcctgcgcggaccccgcgagccccggcgcctgcgcgagtccccgacgccgcccccgcccccactcaccgggccccgcagcaggggccggagccgccggcggcggggcgggggggggcgccccgatgagccccgagtgcgaggagccgccgccccccctcgcagggcgccatgttttggaagtttgacctgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtaccccagtgtggcctgcgagattctgacctcagatgtgccccagatcaatgatgccctgggtgctgatgagtcccttctgaaccggctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattggcacctcggccatcatggacctcctgctgcgcctgctcacctgtgtggagcggcctcagctgaggcaggatgttgtcaattggctcaacgaggagaagatcgtccagcggctgattgagcagatccacccgtcgaaggatgagaatcaacattccaacgcatcccagtccctgtgtgacatcatccgcctgagccgggagcagatgatccaagtccaggacagcccagtgcctacagatgccccgaccagcccccgagtctccggggaggaagagctgcacactgggcctccagccccacaggggcccctcagtgtgccccagggcctccccactcagagcctggccagccctcctgcccgtgacgccctgcagctcaggtctcaggaccccacacccccctcagcacctcaggaagccacagaaggcagcaaagtcacggagccctcagccccttgccaggccttggttagcatcggggaccttcaggccaccttccacgggatccgttctgcccccagctcctcggacagtgcaaccagagacccctctacctctgtcccagcctccggggcccaccagcccccccagaccacagaaggggagaagagcccagagcccttggggcttccccaaagccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacg

SEQ ID NO: 3382 - DNA, 2791 bp, Homo sapiens
gcggccgccgtagttgaatctcctcggcgccggaagccccgccactccgcttcctggttcatgtgcggccttcgttccctcgctatctcgaccttgacttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcagccccgcgtggggagtgcaggtggtttcggttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcaggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgctatcttcactgagatttgccagcaggatgaagctagtcaccactgagcctgccatcaatgaaaagtatgatgctgagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgagccaacaggaacaggaagtggagtccactttgcgcaggaagtacaccctcattgacaggaatgactttgcagccatttctgctatccagaaggcggggcttgtggatgttgatggccacctagtgggtgagcctgaaggacaaaactttggactcggagtcgcccctttctctaccaaacctgggaagaaagccaagtccaagaagacattcaaagagccactcaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactacgggagaagcaaggcaagtacgaaaacaaggggctgatgatcatcgatgaggaagaattcctgctgatcctcaagctcaaagacctcaagaagcagtaccgcagcgagtaccaggacctgcgtgacctcagggctgagatccagtattgccagcacctagtggatcagtgtcgccaccgcctgctcatggaatttgacatctggtacaatgagtcctttgtcatccctgaggacatgcagatggcactgaagccaggcggcagcatccggccaggcatggtccctgtgaacaggattgtgtctctgggagaagatgaccaggacaaattcagccagctgcagcagagggtgcttcctgagggccctgattccatctccttctacaatgccaaagtcaagatagagcagaagcataattacttgaaaaccatgatgggcctccagcaggcacatagaaaatagaacctcatcgccagtaccttaaaggacaagaccagcaactcccacctactgtagtggagctgctcaaccacctgcccagagctgcagccccctctactccaatgctgggacccagcacagagaacacatttggcctgcatgttgggaggagcatcctccaaggacaaccttgctcatctccacagagcactttgggttttaattcactgtcttatatgcagggacaggataaaataactttctagtttggacttt

SEQ ID NO: 3383 - DNA, 565 bp, Homo sapiens
agctgtggttgccggaagttgagcggcggcttctcaaaccccataatgctggtatccagtgcatccgttctcaaaaactgaagctgatggacaccagattgcatgtgaaggtgaaggatattatagcagaaggaaaccaaaataaaagaaaaacagctcctggaagtaaccaatgagaaggacagataagagtttgaagactgtggatgtgactgcttgttccctggttgacacactgaagaagaaatcatgttgattcagagttggcttggaggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcga

SEQ ID NO: 3384 - DNA, 544 bp, Homo sapiens
gccgcccttgcatcctgatgggtccttacagtggggaggctgtaagaataattcaagttttccatctggaaagcatttgcttcgcaaacagccacagcttacagactacaagcagtttagaaacaagactaccacctgaatatactacacatgccttcacctgccttttgatgattgcagcgtcaccctttacaccagaaagctggcgggcactatggggaaaaaacaaaacaagaagaaagtggaggaggtgctagaagaggaggaagaggaatatgtggtggaaaaagttctcgaccgtcgagtggtaaagggcaaagtggagtacctcctaaagtggaagggattctcagatgaggacaacacatgggagccagaagagaacctggattgccccgacctcattgctgagtttctgcagtcacagaaaacagcacatgagacagataaatcagagggaggcaagcgcaaagctgattctgattctgaagataagggagaggagagcaaaccaaagaagaagaaagaagagtcagaaaagcca

SEQ ID NO: 3385 - DNA, 760 bp, Homo sapiens
tggcgatctgggcaaggcattttcatccctttgcagacaaccccggctgctgttaatgctgaaaatagctcaaatgctctcagaacagtagcaccacccagcagctgggattctttccctctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacg

SEQ ID NO: 3386 - DNA, 1692 bp, Homo sapiens
gtgaggctgcggaccgggagcagcggccgcaggcgccatggctgcggagcggacccggccgctgcaaggctctggcggtccgagcgtgcctagtagctgtgaacccggcgcgaggtcccgggccccggggcgctcgctcaggtcagtgccgcgcggaacacgattccgagagcaagggacctgggagcaacgaatgggttgatgggatctggattttagagacgggaaaacagggttttggagttactgcctcctactgcctccatttccttagctgcgaaatgagttaacagtgatgtcccagggctaccaaacgtttgaaagacgatgaagtgtgatgaggtggtttatgaagtacaaagcgctatactgcgccataattgtgggtatgccatgaaaacaggtaaatttttccataaccttatggagagaaaggactttgagacatggcttgataacatttctgttacatttctttctctgacggacttgcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacagggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaacatcctggctga

SEQ ID NO: 3387 - DNA, 2863 bp, Homo sapiens
gttcgcgcctggggctgtggtcttcccgcgcctgaggcggcggcggcaggagctgaggggagttgtagggaactgaggggagctgctgtgtcccccgcctcctcctccccatttccgcgctcccgggaccatgtccgcgctggcgggtgaagatgtctggaggtgtccaggctgtggggaccacattgctccaagccagatatggtacaggactgtcaacgaaacctggcacggctcttgcttccggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctcctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcaaaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaacat

SEQ ID NO: 3388 - DNA, 682 bp, Homo sapiens; identical to SEQ ID NO: 2784

SEQ ID NO: 3389 - DNA, 4065 bp, Homo sapiens
gccccattgggccgggtgctggggcatcccgggcgctgggtgccccgagcggctacgacgagtcccaggtggggccgggctccaggcccgcgggggagcggagccgtgcgccgcaggcgggctccgtgacgccgggtggggaacgccgggccggtggcgggacttccgccacgggactcggaaggggccgcgccgccgctgctgggagttgtagtccggccgtggttgggggagccgcggctcatgcgcggtgcacagaggcttgtttcacatctgtaacaacaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagatcgggcccagcacaggcagcgtcagtgcaaacttcccccaccccgccttccacccatgtgtgtcaaccctaccccaggagggaccatctctcgagcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtga

SEQ ID NO: 3390 - DNA, 575 bp, Homo sapiens
attctttccctctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtagagcgagaataggacagactcgtataccattctgatctgggtgcatttcttcagaagggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaa

SEQ ID NO: 3391 - DNA, 2397 bp, Homo sapiens
ctatgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagaccttgcgcatcattgaccccagaaaaggccaagtggtggcggagcaagcccggcctcacgagggcgcccgcccgctgcgggctgtcttcaccgcagacgggaagctgctcagcaccggcttcagcaggatgagtgagcggcaactcgcgctctgggacccgaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggtccatcaggcagcctcttaccctagagctctctccactctgaggttcagaaggaccccaacccacaccgtaggcgttccccccaagtaaagttaggtagcaaaagcctccggt

SEQ ID NO: 3392 - DNA, 389 bp, Homo sapiens
atacttcactcgctggtacaaaccggaatatgtgtcatcacattggcagaatctcatccagttcttcaaagtggaaaaacaattaaaagcatttcctatcagatcagtaccaactgtagcagacttcagaacaaggtctctgggaaatttaagcggggggcacagtttctaacagagcttgcacctctctgtaagatttactgctcagatggtgaagaatatactgtgtctagttgtgttagaggacgtttgatggaagtgaatgaaaacatcctccataagccatctattcttcaagaaaagccatctactgaaggctacattgcagttgtgttacccaaatttgaagaaagtaaaagcataacagaagggttactgacacaaaaaca

SEQ ID NO: 3393 - DNA, 1645 bp, Homo sapiens
ttttctttgtgcctataatataattggctgattgtgcgggtgatgagcgccccctcccccagcccggtcccagctccatgttcctaagcctgcctcactggtttcggagggctggagagcagctcagctcgctagctgcgcgcttcccggcacaggcagtgccactgcgcaggttgatcagcgaaacagcatccattttaatctgcggggagcccctgccttaccagggcgttctctccgcccgccggtggatgctccgcgcctgccctccgcagcctcgctcagcagtcctgcgttggggtctgcgccctaggatgcactgagatggtacatcaggataactgctcgtatcaggcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaactttgtttcat

SEQ ID NO: 3394 - DNA, 3478 bp, Homo sapiens
aacagaccgccgtgagagaggaggggcgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagctggtggtgtctgtcgattgactgagtgctggagctggcagccctgtgcaggctgccacctttgcccctttactgtgcttgctcctgactctatgtcgcgtctccaaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccaggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacacgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 3395 - DNA, 836 bp, Homo sapiens
ctccgcacctctccatctgccgggaagatctgtgggacaagatccccccccgccctctggcctctccctctggatgccccatgctctttctgggctgctttggggctctggcggctggggggagcggggggctgacccaaggcgggttacacagagaggaaggtgacggggataggccctcggcaggacaggcctactccaggatcggacctacctgagccctgtggggtggctgtccatgttggccctggtccatcaggaggaggaaagaagggagactttggcccaggcttctaggacgtgtgaccgagagctcctgggcctgtgtccccccaggtggtggaattgggcatcctggaccagctctccactgaggagcggaaaaggcaggaggccatgttcgagatcctcacgtcggagttctcctaccagcacagcctgagcatcctggtggaggagttcctgcagtccaaggagctgcgggcgaccgtgacccagatggagcaccaccacctcttctccaacatcctggatgtcctgggtgccagtcagaggttcttcgaggacctggagcagcggcacaaggcccaggtgctggtcgaggacatcagtgacatcctggaggagcacgctgagaagcacttccacccctacatcgcctactgctccaacgaggtctaccaacagcgcacgctgcagaagctgataagcagcaacgccgccttccgagaggccctgagagagattgagaggcggccggcgtgcgggggcctgcccatgctctccttcctgatcctccccatgcagcgggtgacccggctgcccctcctgatgga

SEQ ID NO: 3396 - DNA, 1456 bp, Homo sapiens; identical to SEQ ID NO: 1946

SEQ ID NO: 3397 - DNA, 546 bp, Homo sapiens
agcacaacaatcatttgttgagagcctactcaagactctgtacttgtccgtgacagtcactgggagcatagcctttctccaatgacatcgccctgaacatccactctaaaaatgcagggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacga

SEQ ID NO: 3398 - DNA, 552 bp, Homo sapiens
ggccgggattcgcggcccggagctcgggaccggagtcaggaatggagagaagggtaatggttttacctcttattgtggaaacctgttgagatcacagagaatatactgacggcataaaagggcagaaccatagcagggtgcgaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtg

SEQ ID NO: 3399 - DNA, 808 bp, Homo sapiens
gggtctccctgccaagctatgggggaggggatggtggacatgacaacttccagctcagcggtgctttaggagattttgattcgctttccaaggacaatgtcttcgagaataaccgtttggcctttgaagtggctgagaaggagctggggatccccgctctcctggaccccaatgacatggtctccatgagcgtccctgactgcctcagcatcatgacctatgtgtcccagtattacaaccacttctgcagtcctggccaagctggtgtctcgccacccagaaagggccttgcaccctgttccccgccgtctgtagcacccactccagtggaaccagaagatgtggctcagggcgaggagctctcctcaggcagcctgtcagagcagggcaccggccagacccccagcagcacgtgcgcagcctgccagcagcatgtgcacttggtgcagcgctacctggctgacggcaggctgtaccatcgccactgcttccggtgtcggcggtgctccagcaccctgctccctggggcttatgagaatgggcctgaggagggcacctttgtgtgtgcagaacactgtgccaggctgggcccggggacacggtcggggaccaggcctgggcccttctcacagccaaagcagcagcaccagcagcaactcgcagaagatgccaaggatgttccaggaggcggccccagctccagtgctcctgcaggggctgaggccgatggacccaaggccagccctgaggcccggccgcagatccctaccaagccccgggttcctggcaaactacaggagctggccag

SEQ ID NO: 3400 - DNA, 884 bp, Homo sapiens; identical to SEQ ID NO: 2530

SEQ ID NO: 3401 - DNA, 817 bp, Homo sapiens
cagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttt

SEQ ID NO: 3402 - DNA, 1285 bp, Homo sapiens
tacatgcaacagccagtgagagcaggagacatcggtgtttccagagtccagacccaccacaatgccagccccttctcagttccgaagaaacaggatgaatcacccatgattggggatggagaagattatttcctttctttgtttggtgattcaaagaaacttacagcacactcaaactacactcagaaaactttaaaatacttttctatgattcttgaagaagttggccaatttacctccagttctcttggagatgttgaaatagctgaagtgaatgtcaagggtttgttcgtgaagctcattaactcttcccttgacaaagaaatggcaattggagatcatattctccagcaaaatgtgaatggacaaaccatttctttgtaccgattccttccaaacatcgtaatgcaggcaaattccacagtaacagtgtgggcagcagcatctgaagcaaagcatcaacctccatcagattttctttggaaggaacaagacaagtttagagcaagtcctgattgtataacaatcctgtgcaaaccgaacggtcaagccattgcgtggtacacccctatccactggaagcaagcgtgggaaaaattagatgctgacgttgaatttaacagatgttcagtagtatctccaacattccgaaagcgtgtgtttcagtggacagcatctacagctacaataactaaagaaaaacaagatcaacctaagaaagatatctcaaattatcaggtggaacaagctcaagttcttcttaagagagagaaggaaatcccaccaaccgttttccctaatcgcagcccttggtgccagaatccctatgtctctgcacatccttactgtcctctgattgaaccacacaatacatccaccgctggaggcagattggatagacagcccaggactcggtcaaccagacctaatcgagcctcagggtctaagaaaaagaagacatctgagtcacaaaagcaataagcagtcaactcaacctttaaagatggagtctcactctgttgcccaggctggagtgcagtggtgtgatctccactaactgcagcctccgcctcccaggttcaagtgagtctcctgcgtcagcctcccgagtagctgggattacaggcatccgccaccctgcatggctaatttttgtatttttagtagcaacgaggtttcaccatgttggccaggctggtctcgaattcctgacctcaggtgatctgcctgccttggcctcccaaagtgctgggattacacgcatgagccaccatgcccggcgcaa

SEQ ID NO: 3403 - DNA, 1490 bp, Homo sapiens
agccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagctggagagaatcaacgtctactacaatgagtcatcgtctcagaaatatgtgcccagggccgccctggtggacttagagccaggcaccatggacagcgtgcggtctgggccttttgggcagcttttccggcctgacaacttcatctttggccagacgggtgcagggaacaactgcctgcagggcttccagctcacgcactcgctgggcggcggcacgggctcaggcatgggcacgctgctcatcagcaagatccgtgaggagttcccggaccgcatcatgaacaccttcagcgtcatgccctcgcccaaggtgtcggacacggtggtggagccctacaatgccacactgtcggtgcaccagctggtggagaatacagacgagacctactgcatcgacaacgaggcgctctatgacatctgcttccgcactctgaagctgacaacgcccacctacggggacctcaaccacctggtgtccgccaccatgagtggggtcaccacctcgctgcgcttcccgggccagctcaatgctgacctgcgcaagctggcggtgaacatggtgcccttcccgcgcctgcacttcttcatgcctggcttcgcgccgctcaccagccgcggcagccagcagtaccgggccctgaccgtgcccgagctcacccagcagatgttcgacgccaggaacatgatggccgcctgcgatccgcgccatggccgctacctgaccgtggccaccgtgttccgcgggcccatgtccatgaaggaggtggacgagcagatgctggccatccagagtaagaacagcagctacttcgtggagtggattcccaacaacgtgaaggtggccgtgtgcgacatcccgccccgcggcctgaagatggcctccaccttcatcggcaacagcacggccatccaggagctgttcaagcgcatctccgagcagttctcagccatgttccggcgcaaggccttcctgcactggttcacgggtgagggcatggatgaaatggagttcaccgaggcggagagcaacatgaacgacctggtatccgagtaccagcagtaccaggatgccaccgccaatgacggggaggaagcttttgaggatgaggaagaggagatcgatggatagtcggaatagagccgccccaactcagatcctacaacacgcaagttccttcttgaaccctggtgcctcctaccctatggccctgaatggtgcactggtttaattgtgttggtgtcggcccctcacaaatgcagccaagtcatgtaattagtcatctggaacaaagactaaaaacagcagagaattgcgggttctacccagtcag

SEQ ID NO: 3404 - DNA, 963 bp, Homo sapiens
agctttgcgctcgtgggagagtcccgcctccttctgcgaaccgcaccacccagatcccggggtgcgcggagggcgcgtctctgacggaagccggggcggacggtcggagtccggaagaaaaacagtccgcgacagctaggcgcgtgagaccggccgcccgcagggctgctctggccgggacccgctggccgggagacgcgaacctgccggaccaccgcgcggggacgacggcggccatgagctcgcggaagctgagcgggccgaaaggcaggaggctcagcacatacatcaggaggtctgcctgatcccatggtgaaccccgggaatccgaaatcagattgagataagatcctttagggaagtgacttagcctggtctcttgcctgctctttcacggggaacaacgctaatcgcccacttagtctaagtcacgatgcttggatttgctgctaatcgtcggatttgagagtgggaacaagaaatccggacttttgctctccatcctcttagacatacacgtcgtgacttggaacgtggcttcggcagcgccccctctagatctcagtgacctgcttcagctgaacaaccggaacctcaatcttgacatatatgttattggtttgcaggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgacc

SEQ ID NO: 3405 - DNA, 2099 bp, Homo sapiens
ggggacgtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcagtttgttcgtctgcttgaaagttggccaaaaaatcctgctgctcaccgacttcccgtggtcagctgctgtcaagcgttcactttctcttctgtcattcctcatggaatgagggtggttttgtcttcccgcttcccttgacctcaaaatcaggattaaaacctggggtagcctctgtgctcctttcttctatgccctggtttgttctgtggttctgggcttcttatatccgtgtgcccagggctgaactccttattttcctttctccaagggcagagccgagtcttcagtccctgttggtctttccccacccccacttccagcccaagagccaggaaagggctggtgccacactgtctgctgggatcagcggtggttctttgagctgctgatttgggtgttaggctcttgagctgggatgcagatgtaacagtagctccagtgagtcagacactctgcccagcacattagactgtgtttgaccacttcttccagttcatagtattgacttcagcccaaacggagataactccctgtgtgtccttgaggtattgagctgggctggacagctccccttgagccaactctaggagtacaatgtcaggggaaccccagtttgtgaaaaggacttagactggaggatatttgttatctggggatatgatgcggtggcggcggcgcctcaagataaggggctggggtttctgggtggggggccaacagagtggtgccagtaacagccccagatagaggagtacgcaggcccagcatgaggcaaccttgacccagaaggtggcccagctacccttgatgaaggtcttttccagttctgctccctcatagctgtgtaaccaaaggctctggttagagaatatgaagggccttagcttttagacctgttctacctcctcaccaaatataatggcagacccatgtgtgtctggaatggccttgaattgctctttccttaaaatagctagctcttcaggagagtatctaaggcccactccatcttacctgaaccagttggtaagggtaaccatgacatagagtgaggcaaggaagaagacgaagtggaaggcagaatagttgtaggaaagatgctggacttggactggaggagctggaggggtttcttggtcagctggcctcgcagccccacccctttgccctggagagaggaaatggctgctgggagcagagctgctgaaacacctcttcccctctcccccaactacctttgttaaggctcttgagggttcttatggcactccacagagatctaccacttcttatggttcctcacttggcactcacctttgtctgcctccactgtttcagggcagcagaaacacagtgagggcttctgcaaaacagaacgcaggttttggaatggtcttaaaagatgtgagggtgttaatctaggaaacttcccccgtgaaaagattggtctagtattaaaaagtggaggcacacctgggttcaaattctagctccagcatataagtggctgtgcagactttggtaagatgtttaatcttttgtgcctcgatttctccatttgtaaaatggagcaaatacctacctcacagggttgttgtgagggttaaattaaatgagattatgtaaaagtatctagcacagttgcctagcacattgtgggtactcaataaaaggtaacagcagctataatctgagcattctgggtagaggttggta

SEQ ID NO: 3406 - DNA, 861 bp, Homo sapiens
atggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcagaaatttcct

SEQ ID NO: 3407 - DNA, 4867 bp, Homo sapiens
gcaggcgcgccctggcacccgggccaagacgcccggagcggctgctgcagccagtagcggccccttcaccggctgccccgctcagacctagtcgggaggggtgcgaggcatgcagctgggggcccagctccggtgccgcaccccgtaaagggctgatcttccacctcgccacctcagccacgggacgccaagaccgcatccaattcagacttcttttggtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaggaagcccagtccctcgtgagagagaaaattgtgccattttataatggaggcaactgcgtaactgatgagtttgaagaaggcatccaagatatcattctgaggctgacacatgttaaaactggaggaaaaatctccttgcggaaagcaaggtatcacactttaaccaaaatctgtgcggtgcaagagataatcgaagactgcatgaaaaagcagccttccctgccgctttccgaggatgcacatccttccgttgccaaaatcaacttcgtgatgtgtgaggtgaacaaggcccgaggggtcctgattgcacttctgatgggtgtgaacaacaatgagacctgcaggcacttatcctgtgtgctctcggggctgatcgctgacctggatgctctagatgtgtgcggccggacagaaatcagaaattatcggagggaggtagtagaagatatcaacaaattattgaaatatctggatttggaagaggaagcagacacaactaaagcatttgacctgagacagaatcattccattttaaaaatagaaaaggtcctcaagagaatgagagaaataaaaaatgaacttctccaagcacaaaacccttctgaattgtacctgagctccaaaacagaattgcagggtttaattggacagttggatgaggtaagtcttgaaaaaaacccctgcatccgggaagccaggagaagagcagtgatcgaggtgcaaactctgatcacatatattgacttgaaggaggcccttgagaaaagaaagctgtttgcttgtgaggagcacccatcccataaagccgtctggaacgtccttggaaacttgtctgagatccagggagaagttctttcatttgatggaaatcgaaccgataagaactacatccggctggaagagctgctcaccaagcagctgctagccctggatgctgttgatccgcagggagaagagaagtgtaaggctgccaggaaacaagctgtgaggcttgcgcagaatattctcagctatctcgacctgaaatctgatgaatgggagtactgaaataccagagatctcacttttgatactgttttgcacttcatatgtgcttctatgtatagagagctttcagttcattgatttatacgtgcatatttcagtctcagtatttatgattgaagcaaattctattcagtatctgctgcttttgatgttgcaagacaaatatcattacagcacgttaacttttccattcggatcattatctgtatgatgtggtgtggtttgtttggtttgtccttttttttgcgtttttaatcagaaaacaaaatagaggcagcttttgtagattttaaatgggttgtgcaagcattaaaatgcaggtctttcagaatctagaactaggcataaccttacataatactaggaaaattatgagaaaggggaaatttttggttaaataagagtaaggttcaaacacaagcagtacatgttctgtttcattatgctcgatagaaggcttttttttcacttataaggcctgattggtcctacccagcttaacggggtggggtttttttgtttgttcagacagtctgttcttttgtaaacatttttagttggaaaaacagcatctgcattttccccatcctctacgttttagagaggaatcttgtttttgtgtgcaacataagaaaattatgaaaactaatagccaaaaaacctttgagattgcattaaagagaagggataaaggaccagcaataataccttgtaagttgcttttgtttgtaaaatctgagcttatagttttccttagtgagtaaattcataaggatgggaacatttaaattaagttaatgggcctttaaaaaaaaaaaaaggaaacactcatacctgtagttggaggatgaatactggagacgggttaccaatgtcaggttatactaaaactaaatcagaaagtctgaatgtagcacataatggttctcttctgttgtccaaggctgtaaaatggacagccttgtcacacctccccggtgctgttttacaacgtgagggtagacgctgtcagtaacccagagggaccaggccttcctaggttttctaggcagtcagctgttaaccactcacttagtaaatgtcataactacacctgctccaggaccaatcagtgaaacctgctcggaattaaaggcttcctctgggtgcctgctgaacaactgagctcatgtcatgggcatgtggtggtttctctgttgcctgaaagagccattaaagtcagtcgtgcgtgaagcatctctcttctaaaggatgtgtatttccataaatgctttctgaggatccggtacaaaatgatttcccaaagttctgaagtgccttgagaacatgtgggtccgagtgttataacagactcctcccccgggtcaccttttgcctggtcatcctgttagagtacatctttggaaatccagggtaatattctctttcagagatgctcattgtgtaactctgtgtagggagatagtcactttaaacagctcaaagtagctagctaaaggagtagccttaaatacctaaaagatgacagaagcatagcccttaacaaatcttcagcttgtctctcagtatttcccaatcatgaaaatcccttgctatgtctttcctactagaaatgttctagaatcgctggacggtggggtcagagggcagtcggtatttaggccgtgagcttcccatactactgcaggtccaactcctggcaaccgcgggctcaaggcaggtcattggaatccacgttttggccacagtagttgtaggattgcttttctgtatcataattttagaatgctcttaaaatcttgaggaagagtttttattttttatttatttttgagatggagtctctgttgcccaggctgcagtgcagtggtgccatctcagctcactgcaacctccacctcccaggttcaagcgattctcctgcctcagccacctgagtagctgggagtacaggcatgtggcaccatgcctggctaatttttgtatttttaatagagttgagatttcaccatgatggtcaggctggtctcgaactcctgacctcgtgatccgcccgcctcggccccccaaagtgctgggattaacgggtgtgagccacggcgcccagcccaggaagagtttttaaattagagctctgtttaattataccactgggaaatcatggttacgcttcaggcatattcttccccagagtactacttacattttaaatttcattttgtaaagttaaatgtcagcattccctttaaaagtgtccattgttctttgaaagtagacgtttcagtcattcttttcaaacaagtgtttgtgtaccttttgccaagctgtgggcatcgtgtgtgagtacagggtgctcagctcttccaccgtcattttgaattgttcacatgggtaattggtcatggaaatgatcagattgaccttgattgactgtcaggcatggctttgtttctggtttcaatctgttctcgttccttgtaccggattattctactcctgcaatgaaccctgttgacaccggatttagctcttgtcggccttcgtggggagctgtttgtgttaatatgagctactgcatgtaattcttaaactgggcttgtcacattgtattgtatttttgtgatctgtaatgaaaagaatctgtactgcaagtaaaacctactccccaaaaatgtgtggctttgggtctgcattaaacgctgtagtccatgttcatgccaaaaatggctgggaacgtttgctttatttacattcagtcagcgttgctttcagatcacactttatccacacaggaaagccagtcagcctataatgaagtagttattaaaataaatgtaatgaatatgtctacaaagtatagtttagtggtttattttgctaaaatgcacatatatttgatataatttagtttgagaagttcagctagtttttctcctttgtttgactttgtcaatttctatctggtttttaagggtctgagcttagcttgtgcatgcaaggttttgggtttttttattttttttttgagcacagcttttcaccttttaatttgttgggtatttttctcttaataagagaaatattggccatcgatttttacatataatacaagtgtgtttttccagtacattggttcctgtcccctctctgtgaactgtttgagtattggaacagtatgtcttcaataattcaatgttactttgagatacatgtgttaatatacccttagttattcttgaaataaaaccagtctcttacgcttgcagtggagaaagg

SEQ ID NO: 3408 - DNA, 2175 bp, Homo sapiens
ggcgagcgcggcggccggggtggtagtggcagtgttcgtgtgctcaggtctgaatcgccgagggaggaggcggtggaggaagaggtggcggcggtggcggtggtcgtagcggtggcggaggaggcgggtacgaatcagctgcgggcggagacatggccaacatcgcggtgcagcgaatcaagcgggagttcaaggaggtgctgaagagcgaggagacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgctactttagtgtttagcagtgtaccaagactagcaagagtttgcttcaggattttgttgaataattaagataatattttgagtgtgtcagggccattcaaattgttggtgttgcatcacagctaccttaactgtttttaacatggatcctctgtgcctgtgaatttacttgcatgcttgtacttgacttcttaggatgggtagctgaaaagaccaccattttaagcatttgagaattcttaaatatgaaatttattcagaattgaagatggtgacctattcagagcctttttgtccttgtcaacagactgggacagtgtctgattcccccttcaccccccccacccccgccttgccacacacagctaatattctaatggtaaatttctctgtatcaggtggggaaatgtgctgaaggacagtatgtatcccttgcttcatttttaggtcgtaggtttggaatgtcttgtcccagttcttcaaacactcttaaatttttcttaagtaatgtaaaaatggaactgccaattttatttctcttgcaaaaatagtaaatacttgatgttacattattcccaggtttaatgaaagaacccaacttagtttttcagtgaatttgacacctattttttagtgatgaaatttttctttgagaactggcaaggatgcagtcagctgtttgcagtttttagcctgattttggggtctatagagattgctttattggatacttcaagtcattcttgcttgcacttcccctattgacacatgaaagctgtgttggtgttttattgtacatacttcagatgcacataggaatagaagtgtgttataaatctagctttctttatgatgtttctgataatacgagaattgaaaactttaccttctcttgtacatagtcagactatttgtattaaatttacatttcattctaagttcaaaagtttgaaaattattagttttgcaagatcacacactaatgtaaccattttatgaaggttgaagtggatttatgcaggcagttctatatatagaaatacaattctttttaaatttttaggaccaatacaaaataacaaaaatgtaatggaatcagactgaattaaagtaaggctgtatattgaaagtcatattataaaaggtttgctttctttaagtgttatttatcttaaattataatcgttaaatgtttggaagataatttttgaatcataacgtcagcataacttcatttgacttctcaataatcttgatactagaagcaataaaagaa

SEQ ID NO: 3409 - DNA, 820 bp, Homo sapiens
gagtccctgcttcgcagagcaccggacttggagtcagagagacctggctgcgaatcccggctccgccactttctagcgctgtgaccttggcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggcc

SEQ ID NO: 3410 - DNA, 3007 bp, Homo sapiens; identical to SEQ ID NO: 2738

SEQ ID NO: 3411 - DNA, 762 bp, Homo sapiens
gcggcggcggcagcggcagcggcagcggcgctgagttttgtctcccgggccgtctgggcgcgcgcgggtgtcccagactcacttttccccttcgtctttctctccctttctgtctttctgtgtctcctccaagaatgaaatatgactgaggactctcagagaaactttcgttcagtatattatgagaaagtggggtttcgtggagttgaagaaaagaaatcattagaaattctcctaaaagatgaccgtctgggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatc

SEQ ID NO: 3412 - DNA, 1737 bp, Homo sapiens
acgtgatgcgccgggagcgtcatcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcgcaacatactattcatgtagtggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtcaattatattccagaagtgagaatcatgtcaattcccaaccttcgctacatgaaggagagccaggtcctcctgactcttacaaatccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaaaaggttccactggagggcagatcccaaaggacagtatcaccgtaaacctgcgttaaaatgtggaagctgctgcttcattaggccttgtttataacgatgtacccatgcactacggaattctattgctaagaaagtgggagcataggcaaggcattgggaacacagggtagctgctgttgctcttgctctcacccctgttgacaccagtaagtctgtgtctccctcactgaaccctgcacgttgagtaacagcagcataattccatcctaggaaaggggatgggtgttcctt

SEQ ID NO: 3413 - DNA, 684 bp, Homo sapiens
gtacgggagctggaggctgagcttgatgcagagcagaagaagcacgccgaggcccttaagggcgtgcgcaagcatgagcgccgtgtcaaggagctcgcataccaggccgaggaggacaggaagaacctggctcgcatgcaggacctggtggacaagctgcagagcaaggtcaagagctacaagcgccagtttgaggaggcggtgagtgcgctggggcctggacacctggaccgggcaccccagctctgccccagggtctgtggccaggagcagcaggccaacaccaacctggccaagtatcgcaaggcccagcacgagctggatgatgcggaggagcgggcagacatggcggaaacccaggccaacaagctgcgggcacggacccgggacgccctgggccccaagctatccctttctcctcagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctcca

SEQ ID NO: 3414 - DNA, 1124 bp, Homo sapiens
acggggcggggacgagctgtcgcgctggttgctcgtgcaggagcgggacccggaacagaccgccgtgagagaggaggggcgccggccgggattcgcggcccggagctcgggaccggagtcaggaatggagagaagggtaatggtgttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagc

SEQ ID NO: 3415 - DNA, 4115 bp, Homo sapiens
ccgcctgcaccgccgccgcgccccattgggccgggtgctggggcatcccgggcgctgggtgccccgagcggctacgacgagtcccaggtggggccgggctccaggcccgcgggggagcggagccgtgcgccgcaggcgggctccgtgacgccgggtggggaacgccgggccggtggcgggacttccgccacgggactcggaaggggccgcgccgccgctgctgggagttgtagtccggccgtggttgggggagccgcggctcatgcgcggtgcacagaggcttgtttcacatctgtaacaacaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagatcgggcccagcacaggcagcgtcagtgcaaacttcccccaccccgccttccacccatgtgtgtcaaccctaccccaggagggaccatctctcgaggctgaacgttaacatttccaacatggcagcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtgacc

SEQ ID NO: 3416 - DNA, 759 bp, Homo sapiens
agtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaaggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcag

SEQ ID NO: 3417 - DNA, 8807 bp, Homo sapiens
gacgtcggcggtgacaggccctgggactctgggaatacccagcttcctccccgcaacccggtgaaagccaacgcaatgttcggtgcgggggacgaggacgacaccgatttcctctcgccgagcggcggtgccagattggcctcactttttggactggatcaggcagctgctggccatggaaatgaatttttccagtacacagccccaaaacagcctaagaaaggccagggaacggcagcaacaggaaatcaggcaacaccaaaaacagcaccagccaccatgagcactcccacaatactggtcgcaacagcagtccatgcatatcgatacacaaatggtcaatatgtaaagcagggcaaatttggtgctgcagttctggggaaccacacagccagagagtataggattcttctttatatcagtcaacaacagccagttacggttgctaggattcatgtgaactttgagctaatggttcggcccaataactatagcaccttttatgatgaccagagacagaactggtccatcatgtttgagtcggaaaaggctgctgtggagttcaataagcaggtgtgcattgctaagtgcaacagtacctcttccctggatgcagtgctctcccaggacctcattgtggcagacggccctgctgtagaagttggagattctttggaagtggcctataccggctggctctttcagaatcatgtgctgggccaggttttcgactccactgctaacaaagataagttgcttcgcttgaagttaggatcaggaaaagtcatcaagggctgggaggatggaatgctgggcatgaaaaaaggaggaaagcgattgcttattgtccctccagcctgtgctgttggctcagaaggggtaataggctggactcaagcaacggactcgatcctggtgttcgaggtggaggttaggcgggtgaagtttgccagagattctggctctgatggtcacagtgttagttcccgcgattctgcagctccgtctcccatccctggtgctgacaacctctctgctgatcctgttgtgtcaccacccacatcaatacctttcaaatcaggggagccagctcttcgtaccaaatctaactccctcagtgaacaacttgcaataaatacaagtcccgatgcagtcaaagccaagttgatctctcggatggctaaaatgggccagcccatgctgcccatccttccaccacagctggattccaatgattcagaaatcgaagatgtgaacactctgcaaggaggtgggcagcctgtggtgactccgtccgtccagccctctcttcatccggcccatccagcgttaccacagatgacctcacaggcacctcagccatctgttactgggctccaggcaccttctgctgccttaatgcaagtgtcatctctcgattcccactcagctgtatctggaaatgcccaatcctttcagccctatgcaggtatgcaagcctacgcttatccccaggcatctgccgtcacctcccagctgcagcccgttcggcctttgtacccagcaccgctctctcagcctccccatttccaaggatcaggtgatatggcttcatttctcatgactgaagcccggcaacataacactgaaattcgaatggcagtcagcaaagtggctgataaaatggatcatctcatgactaaggttgaagagttacagaaacatagtgctggcaattccatgcttattcctagcatgtcagttacaatggaaacaagcatgattatgagcaacatccagcgaatcattcaggaaaatgaaagattgaagcaagagatccttgaaaagagcaatcggatagaagaacagaatgacaagattagtgaactaattgaacgaaatcagaggtatgttgagcagagtaacctgatgatggagaagaggaacaactcacttcagacagccacagaaaacacacaggcaagagtattgcatgctgaacaagagaaggccaaggtgacagaggagttagcagcggccactgcacaggtctctcatctgcagctgaaaatgactgctcaccaaaaaaaggaaacagagctgcagatgcagctgacagaaagcctgaaggagacagatcttctcaggggccagctcaccaaagtgcaggcaaagctctcagagctccaagaaacctctgagcaagcacagtccaaattcaaaagtgaaaagcagaaccggaaacaactggaactcaaggtgacatccctggaggaggaactgactgaccttcgagttgagaaggagtccttggaaaagaacctctcagaaaggaaaaagaagtcagctcaagagcgttctcaggccgaggaggagatagatgaaattcgcaagtcataccaggaggaattggacaaacttcgacagctcttgaaaaagactcgagtgtccacagaccaagcagctgcagagcagctgtctttagtacaggctgagctacagacccagtgggaagcaaaatgtgaacatttgttggcctccgccaaggatgagcacctgcagcagtaccaggaggtgtgcgcacagagagatgcctaccagcagaagctggtacaacttcaggaaaagtgtttagccctccaggcccaaatcacagctctcaccaagcaaaatgaacagcacatcaaggaactagagaagaacaagtcccagatgtctggggttgaagctgctgcatctgacccctcagagaaggtcaagaagatcatgaaccaggtgttccagtccttacggagagagtttgagctggaggaatcttacaatggcaggaccattctgggaaccatcatgaatacgatcaagatggtgactcttcagctgttaaaccaacaggagcaagagaaggaagagagcagcagtgaagaagaagaagaaaaagcagaagagcggccacgaagaccttcccaggagcagtcagcctcagccagttctgggcagcctcaagcacccctgaatagggagaggccagagtcccccatggtgccctcagagcaggtggtcgaggaagctgtcccgttgcctcctcaggccctcaccacttcccaggatggacacagaaggaaaggggactcagaagctgaggcactctcagagataaaagatggttcccttccacccgaactgtcttgcatcccatcccacagagttctagggcccccgacttcaattccacctgagcccctaggccctgtatccatggactctgagtgtgaggagtcacttgctgccagcccaatggcagctaagcccgacaacccatcaggaaaggtctgtgtcagggaagtagcaccagatggcccactacaagaaagctccacaagactgtccctgacttcagaccccgaggagggggacccactggccttagggcctgaaagcccaggagagcctcagcctccacagctcaagaaagatgatgtcactagctccaccggtccccacaaggagctgtcaagcacagaggcaggttccacagttgcaggagcagccctcagacccagccatcattcccagcgttccagtctctctggggatgaagaggatgaactgtttaaaggggcaactctgaaagctctgaggcccaaagcacagcctgaggaggaggatgaagacgaggtgagcatgaagggacgcccgcccccaacgcccctttttggagatgatgatgatgacgatgacattgactggctgggatgaagacccaggaaactggtgcaaaggtttctctgcaacccttccctaagcatgattttgcacagccaaccctgggtctaggcgaaccacagggtgaggtcaaggtgagcattctgggaacaatatttgggctcagagggtgggttggccaccttctgagccccacccccgccagacctggtgaagaggatcataaccctgtcttcaagaacactgggatttcagcagcaagttggaagaaggactggtaggttcccctccaagccagtcacctgtaagagtcctgtcctctgccagactttttaatctcttcattaactctcagactgacctgggagccctcctctacctgaatccagtgctcaactgtgccccggcaacaagacctgggctgaggtctccctggtagaactaagggagattacaccatctaaatcccagtgcagtcaacagcctggcctatagtcctgggacatgtatcttcttctttgccttaaatctgatacaagaggtcaatgactttgaaaataaaactaaaataaatgtctataatgaaacttgacccaagcccttggagaaaaattgagtttggttccaagggctgtctgtgctcttttgggaatctaagggtaggagtcttacagatctgggtcagttaatgtgcacaaaacgttgtggcatatttactccctttgatacctaaccctggaacttttaggctttcaaagaaagtcaccactgtagtcctagctcatccctggggcatgatggttctgtgaggaccagtccagtcatcctcttgctcctgcaggcttagtcctgcagtctaggaagccatgcaaagaaggtgagagggtcccttctttccattgttcatggcacctgagggattcttcactttgagagcagcttccattcccttagaactcatgggaccaggacttatgcagagaacagtagtgagaaaatacttgtggtcattttcttgattccaggatcttccaaagattatgcaatcagtctttaaaaaaacagaataattaattttaataaaaaatgtttcttgattttaaatgttttaaaagataggacccaaaattccacttcatctggcctggcatcatccttgcaggctttggatatgtctcccgtgtgcggacctgggaggcagtgagaactaattatttctttgttgcttaacaaaaggcggtgctgtttggcactttcacagactggcttatctccagcaaccactgcagaagacagtgttatcaccattttatagaggagaaaactgagacttagagaggtaaagtaatttgcccaaagttacatatctaggaagcctcagcacaagaattcaaatcctggccatctgattccagagcctgggctcttggccagcacagcctgactgtcactggttgggggaaggggcggtgatgcttttagaaacaggcttcttgagacaccaggcagctttccagttccctgcaaacatgggggaatgccctgatcagtcctaaaggtgtgacatagtctactttctagggcagttatttcttattgtaaattaactagtggctattatatttgcttctgcccgcagggagagaagatgctgagtaattgtgccaacacaggtgcttaaagtccgtgtgacagttacttttcttatagcatgtactcaattaatacttgttacatgaatgaagaatgacttgacttgcctcagttggcattctggggtgtctacctgggtgcagcatttcagggctgggtttccctgagcagagttgtctttgtagcagatggatggactctgtcctcagacaggcttataaagagtactaccagttctattagccccactcagcccctgcagttgttacaagggttcatgtgctttctgttggaattaggagaacagaacagtcatagactatttaaaaatatatatttactaaaatgtatttgtttgtttttaattcccaaagcttacaaccatcttttcatctaatctgtgaggtatttagtatacagcagtgattttctctctttccttttttataaagtgaagaggttcaactatccagagagtcccatctaactcaaaaaatgtaatggctttggttggattgcatcttcagtcagtacctgcccatggcttaatcagtattttaagtgaatgaatcatgtttccccactagatcattacgagtaagcagtaagtaataaatagagaatattaagtattgaacattattagatgcagctttttgttctgcatagaagaaagatgaggataaaggagggcattgaggccacgaagagcttcccagacacccacggccatcagatcatcttcttcctgcaggcagtgccttctggtggaaggagctcagtctatcagagaataaaccaggagcctgaaagcagtcctgtgtctctgcctttaatcagctgtcacttattctctccccaagaaagggaaataggtctcagcagtttctgccatccatcatgaatcaatgaaatcatttcattaaaaatttttttgtatgaatgtgcaaaattgccaactaggagttcaatgggaaaaataaaaaaaacttagtttgtcaacatgatccatagacgagatgatcttcatgtgttccaaaggcagaaaggtgagaaaaaggatctagcttggtctctgtccctcaaagacagaagaggtcaggaagtccaatgggcgatgctcctgtagataaggcacaaagcaggagagctgagggtgtccaggttccatgccctgcatcaccaagaacccttctccctggcttgaaatctttggaaattcctggtttgagtcacagagaagcattgtcatgggctcagtaaccctgccacccctgttatctccattctccctttggtcacagcagctgtcttaagacacaagaccatgcctgggccctacgtaggctggctgagaaggaaggttgctgcaatggcttccgaactccagggagcaagtgctggcttcagctcaaagtttccaggggctgggaataaggtggaggaatagccatcagaagaaagggcagttggaagtatagtgtctggaagagggggctccatgtccctccagcctcagtgcctgcacgttcctcaccagctaagctgtgctgagaagtgggtaagctaggtagtagcccacagcagagcccaagaccacaccaaggaaaatccaggtgttgtaggacattacggccagcatgatgaagtagccgatgaccacctggatgacatggattagagactggccaaagtgacacaaataccacctagataaaaaggagaagcaagttaatcctggtaatgagctggtaatgaggaagctgggagtagatatcagggagtagaaagctgttgagttacgtgacccgattgatttataacttgtatgcttaacccaggagtgatttctttctgcccctcccacccccgcccccagaaaaaactcgagatttatttttaaagagacatatcttcactacatttggtttcaagcttcctggcatcctaggcaaaggggaaaatgagggtatctataatctgtctttctgataaggaataagagaaaatcatcagtaaggcatatttcccccctgaatctacttcgggaggcagtatgacaatggaaagaaaaagcatggtcttaggtgacattatcagttcctagacctgccactaactaaaagtggcctagacaaatgtcttaacctctctgaacgtaagattccttatcagtaaaacaggaatgagaatacttcccttgcagtgcagttgtgaagatctgagacacccatgtagggtggctagtgatggagcgggcaggcttattaagcacaggtgaggctggggctggacagagggcagaacagggaccctaaatggttgcctgattcgagtgggaagggaggagaggagagcttgtcatcctcctcccaccaagtgggatacattgcttcaggacagctgcagatcccctcctggatatgggagcctagtgacccatggaactggtgagatttgggggagggtgggtggccacctcatttgctagataggggcctgcacctgaagatcactgttccctaaagaaagccttctgagcctctcaagtggctggctgttcacagagtgctttggcctgggcatcaggagacatgagctctagttcacttggctatgtgtagccactttggcaagtcctggtccttccctgggcctcgctgtcctctctgtgaagtggggctaatgctgtctgggccagcctgtctctcagggtgaatgtgaggcttctgcccctttcccatacccactgcctgtacctgtggtgggttctgccaacagggaatgaatctgagcctgcagagtccccgtctgtctctgcgatggtctgctggctgatggaggttggcaggttcaccagtacctggttgagcagcttggctttgccaaccttgatgccttcatacagtacagccagaagcaggagcaccaacaccgaaagggccatgcctgtcaaaggaggcagagttgtggagacctggccaggccagcactgtttcccttccagcacctccacctgttcatggaatccactccatccacctctatcctgcaccttcttccccacccttgctgagttccgaacttcttcactgtcttcaccagacttttcttagctggagtgtggctttgagatcaggaagagaagccacctgaaaaatccaggggctgagggtgaagaagccacgtaccattaccccacccactcccccagcaggctgcacaaatctgtcgtgacttcttgttaagtgatgagtactgcaaggtcctatttatatgtaagtatgcaaaaaatgtctggaaggaaagataaatagcacaagagtaatagttatctcagcaaagtaggatacaggtggtttttatgttcttgcctaactttctaaggtttcttttatatatattacttttataataggggaaaaacccaataaattattttaccaaaacta

SEQ ID NO: 3418 - DNA, 1728 bp, Homo sapiens
tgaggtttggtctctgttgtcacaacattcagtacaatctgctgcccaggacctggacattgacagataaaatgaagtgggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcagggatagactccacaaataataaaaaggaagagtatggtcctggtgttcaaggaaaagaacattctgctcatttggatccttcagctcctccgatgcccttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgtatgtgccaagagttgtaacctctgcacaacagaaagcaggaagaactattacagcccggatcacaggaagatgtgattttgcttcaaaaaatagaattagcagcagtttagctataatgggagtttctcctcccatgagctcagttgttgtggaaaaacatcatccagtcacagtgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtg

SEQ ID NO: 3419 - DNA, 402 bp, Homo sapiens
atgagtcccagccagatgatcatgcccaatgtcatggagatgatcgcagccctgggccccggcccgtccccctatcccctcccgcctcccccagggggcaccaactccaacgactacagcagccaaggcaacaactaccaaggccatggcaactttgacttcccccacgggaaccctggagggacatccatgaatgacttcatgcacgggcccccccagctctcccaccccccggacatgcccaacaacatggccgccctcgagaaacccctcagccaccccatgcaggaaactctccttcccgaactcacaaatcctgacgagctcctgtcttatctggacccccccgacctgccgagcaatagtaacgatgacctcctgtctctatttgagaacaactga

SEQ ID NO: 3420 - DNA, 2587 bp, Homo sapiens
cccatctctacgaaaaatacaaaaattagccaagtatggtggccggcgcctgtaatcccagctactcgggagactgaggcagagaactgcttgaacctgggaggcagaggttgcagtgatccgagatcgcgtcactgcactccagcgtgggcgacagagcgagactccgtttcagaaaagaaaaaaaaaaaaaaaaaaaagggagtcggggtggagctctcattggctcgttgcatgtgagtgtccctacggcctagaaatacaagagaagcacatcggaacgggctggaaatccacccagttaactagagggctttgaaccttttattaacttggaggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaagacctagaaaataagtccccttcctgcctgttgcaaagtaacgtaagagttccctcacccgagtggatgcagaccttcttgctgtcagccacccttccttcatacacatagccagcccaggtgaccagaacctcccaggacagatgaggctttgtgtccttatgagactgggagaacctgctgggcacccctgctgcaggtgctgtggtgggtggggaccccactgcccttcccactgagcacatcatggctacctgacttggtgggagctccaggcagtcacttctgtttcttaaacatagctttactgaggtacaattcacataccatgtaattcacccacgggaagtgtatgattcagtggtttctaatacagacttctgcagccattaccaccgtcaactttacgacattttcatcagcccaagaagacaccctacactccttagctgtccccatccaactcccccaccccagtaaccactcagaataggtatggatttgcctattctggacgtttcgtataaatggcgtcatacacta

SEQ ID NO: 3421 - DNA, 2042 bp, Homo sapiens
ggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcaattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaaatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggtctgggattcccccctctgctgccca

SEQ ID NO: 3422 - DNA, 965 bp, Homo sapiens
cggagaaatgtggagctgattaatgaagaagctgccatgttcgatagtcttctcatggactcttatgtgagctctaccactggggagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacaggcagtctgggcactgggaaacatagctggagatagctctgtttgccgagattacgtcttgaactgttccatccttaatcctttgttaacactccttaccaagtccacacgactgacgatgacacggaatgcagtctgggccctgtcaaatctctgccgagggaaaaacccacccccagagtttgcaaaggtctctccttgtttgcctgtactgtctcgcctactcttcagcagcgactcggacttgctggcagatgcttgctgggccctttcttatctgtctgatggccccaatgagaagatccaggcagtcatagactccggagtctgccggagattggtagagctgctgatgcacaatgattacaaagtggcttctcctgccctgagagccgtgggtaacatcgtcactggggatgacatccagacccaggtcattcttaactgttcagccctaccttgccttctccacttgttgagcagtcccaaggagtcaatccggaaggaagcttgctggactatttcaaatattactgctggcaacagggctcaaatacaggctgttatagatgcaaatatcttccctgtgttgatcgaaatccttcagaaagcagagtttcgtacaaggaaagaggcagcctgggccatcaccaatgccacatcaggaggaacccctgagcagatcag

SEQ ID NO: 3423 - DNA, 1842 bp, Homo sapiens
ggagacgcccgcccggtgcccgccctgggcccggcgggtgccccctgcccgccgcctgacgcaatccgaggcgcccttgctgcatgccggcgctggagaaacctcccctgccgttgcatcactcctgccaggtttgccacagaggtggagctgaaccaatcagcgggcgcgctgggcccgcggcgcggttaagtgagaagcagaatccgaagttgattggccaaaaggggatttgccccaccccaatcaccgcggcagctggccgcggtgggcgtggtctcccggcaagaaggtttaaagggcgcctccatggggggcgctcagctggagctaccgagcggtgccaggccaggtgtgtgcgtccgtcggtctttccgtgcccacgccggagaccagccccggaggccgcctgggcctatccctgtgccaggcaccatgaagcaggagtctgcagccccgaacaccccgcccacctcgcagtcccctacgccgtccgctcagttcccccgaaacgacggcgaccctcaagcgctgtggattttcgggtacggctccctggtgtggaggcccgacttcgcctacagcgacagccgtgtgggcttcgtgcgcggctacagccgccgtttctggcagggagacaccttccatcggggcagcgacaagatgcctggccgtgtggtgacgctccttgaagatcatgagggctgcacttggggcgtggcataccaagtgcaaggggagcaggtaagcaaggccctgaagtacctgaatgtgcgagaggcagtgcttggtggctacgataccaaggaggtcaccttctatccccaagatgctcctgaccaaccactgaaggcattggcctatgtggccaccccacagaaccctggttacctgggccctgcgcctgaagaggccattgccacgcagatcctggcctgccggggcttctccggccacaaccttgaatacttgctgcgtctggcagacttcatgcagctctgtgggcctcaggcgcaggacgagcacctggcagccatcgtggacgctgtgggcaccatgttgccctgcttctgccccaccgagcaggctctggcgctggtgtgaggggctgagcccctgcggggagtgctcatgtggacatcagggccagacacccactccagtgcacaagacagacttgcgaccgcttgagcccactgagcagatatggtgggtggctggaggcttctctttctcagtccctgcctgtctgccagcctgcagctctcctgcttgacactgacttactacttgaaactttatttattgcaccatgttggtgtggtgggcaggtggagggcctgccctggacacaggggccctgctgagcagtggccccatcctggaacttgaccagattccccccagtgctgctgctaaccccacaccacccaggcctccacctccccagggagtctccaagagcctcgatcctctgctcactcagcccagccatccatagccctgggaattccacctgccaaggatcccagcaggctggatgagggatagtagggcatgaggagaaggagccctgtaaggactgaggccccggccagcccttctcctccaccagttccccagagcagagctggagctgatgcctggacacagctgctgagcctggcctgggcctcttacccacttggttgttttcttgtccctctgtctgtctgtctatctacttgtctgtctgggccactcctgcctgtgtgttggtctattcctgggaagctcatcactacaggccctggcaaccttcccagtctgtcccatactgttacccataaaactatctcttta

SEQ ID NO: 3424 - DNA, 1124 bp, Homo sapiens
acggggcggggacgagctgtcgcgctggttgctcgtgcaggagcgggacccggaacagaccgccgtgagagaggaggggcgccggccgggattcgcggcccggagctcgggaccggagtcaggaatggagagaagggtaatggtgttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagc

SEQ ID NO: 3425 - DNA, 1070 bp, Homo sapiens
acgccttgacagcggctttcaacccccacctcagcccagcaattcgtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgaggtgaatgccctggatgggtataaccgaacagccctccactatgcagcagagaaagatgaggcttgtgtggaggtcctattggagtatggtgcaaaccccaatgccctggattacaacaatgatacaccgctcagctgggctgccatgaagggaaatcttgagagtgtcagcatccttctggattatggcgcagaggtcagagtcatcaacctaataggccagacacccatctcccgcctggtggctctgctagtcaggggacttggaacagagaaagaggactcttgctttgagctcctccacagagctgttggacactttgaattgaggaaaaatggcaccatgccacgagaggtggccagagacccgcagctatgtgaaaaactgactgttctgtgctcagctccaggaactctaaaaacactcgctcgctatgccgtgcgccgtagcctgggactccagtatctccccgatgcagtgaagggccttccactgccagcttctttgaaggaatacctgttacttttagaatagccggagaagatgtttgcaccatcgtgcaggcagctctgggtgaggttgtccctgcagtactccttgtcacagaaaacagaaaaacagttgttcctgttgtgtggtttatagatttcgaagcaacatgtcacaacaataacctccatagcacctccccttcccaaaccaaacaacccaacaaaaaaaatccctcacttttgttttctgtttattgcttacctggcttt

SEQ ID NO: 3426 - DNA, 582 bp, Homo sapiens
gagcctgttcagccccactggttttactgcaaggaggtagaatacaaacaactgtggatgccttttagtgtgttcgactctttgaatcttgaagaaatctataattcagttcagccagatccggagagcgtggttcttggcacggatggagggcgctacgatgtttacctctatgaccgaataaggaaggctgcctactgggaagaggagccagccgaagtgagacgctgtacttggttttacaagggggacacagatagtcgatttattccctatactgaggagttcagtgaaaaactagaggttattgttcagttccagccctcctcagtgccagatgaatggggcaccacgcaagatggacagacaaggcccagggttgtaaagcgtggaattgatgataaccttgatgaaattcccgacggggagatgcctcaagttgaccatttggtgtttgtggtgcatggcattggacctgtgtgtgacttacgctttaggagcattattgagtgtgtggatgattttagggtggtttctctcaaattgctgcggacacatttcaagaaatctttagatgacggg

SEQ ID NO: 3427 - DNA, 1103 bp, Homo sapiens
cgcggctccagggccacgttccagggtcgggtttggtggattcctcagtccctgccgccgcggggcgccctgggatagcggcggggcctcctgaacagatctcggcccctttccaaacactcctgatgcctcatttgcctctcgcttcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggctactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatgga

SEQ ID NO: 3428 - DNA, 1397 bp, Homo sapiens
agtggcgctagcggcggacccggctgggcagttccttccccagaaggagagattcctctgccatggagtcctacgatgtgatcgccaaccagcctgtcgtgatcgacaactgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgtgcacatgcgagtgccgtgtggccctgggaccctgggcccagaaaggacgatgaactacctgcagtggtgatggcctgaggcctggggttgaccactaactggctcctgacagggaagagcgctggcagaggctgtgctccctcctca

SEQ ID NO: 3429 - DNA, 665 bp, Homo sapiens
gtgaaggtgagcgcctgggtcggcccgcgggcttcctccggccgcgctcggattgagggccgggcggaggtgccgcccttgagagcagccggttgtcgatgccgctcccctcagggacggctccgggcgggaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttacca

SEQ ID NO: 3430 - DNA, 1323 bp, Homo sapiens
agatacttgccttcatgttttggggctagtccctagttcctacttgtcagcccgggtgtaactccacaccacccctgtggctctccaccctttcagatcaagatgctgtcagatcggaaacgggagctggagcatcgtctcagcgctactttagaggaaaatgacctgctccaagggaccgtggaggagctacaggaccgggtgctaatcctggagaggcagggccatgacaaggacctacagctgcaccaaagccagctggagcttcaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcaggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagc

SEQ ID NO: 3431 - DNA, 711 bp, Homo sapiens
gcatatgctctccaaagtgggaatgtgggattttgacattttcttgtttgatcgcttgacaaatggaaacagcctggtaacactgttgtgccacctcttcaatacccatggactcattcaccatttcaagttagatatggtgaccttacaccgatttttagtcatggttcaagaagattaccacagccaaaacccgtatcacaatgctgttcacgcagccgacgtcacccaggccatgcactgctacctgaaagagccaaagcttgccagcttcctcacgcctctggacatcatgcttggactgctggctgcagcagcacacgatgtggaccacccaggggtgaaccagccatttttgataaaaactaaccaccatcttgcaaacctatatcaggtaagggagcccaacctggagccagccacagtatggtcaatcgccttaggcccggtgctcaagcctgaatcttgcccatggagaaagccttgttttagggtcctagaagttcaaagacgaatgaaacacaatctctgccctcaaaaatttgttcaaactcagatgctcaaaatgagcaaaatccaagcaaacttaatcccagtttgaaagaggtttgaggaattagctcatgtcgatacaattgttttttaaaatctctaaagagtaaatacttgtgctgttctttgtatccaaagaccttactagaataaagtgag

SEQ ID NO: 3432 - DNA, 1770 bp, Homo sapiens
atggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgggctgtgcggagacacctgttcccccagcactcagcccctggccgaggtgtcgtctgggagtggctgagcgacgatggctcctggactgcctatgaagccagcgtctgtgactatctggagcagcaggtggccaggggcaaccagctcgtggacttggcccccctggggtacaactacactgtcaactacaccacccacacgcagaccaacaagacttccagcttctgccgcagcgtgcggcgccaagcagggccgccttacccggtgaccaccatcatcgctccgccgggccacacaggcgtcgcctgctcttgccaccagtgcctcagtggcagcagaactggccccgtgtcaggccgctaccgccactccatgaccaacctccctgcataccccgtcccccagcaccccccacacaggaccgcttctgtgtttgggacccaccaggcctttgcaccgtacaacaaaccctcactctccggggcccggtctgcgcccaggctgaacaccaccaacgcctggggcgcagctcctccttccctggggagccagcccctctaccgctccagcctctcccacctgggaccgcagcacctgcccccaggatcctccacctccggtgcagtcagtgcctccctccccagcggtccctcaagcagcccagggagcgtccctgccactgtgcccatgcagatgccaaagcccagcagagtccagcaggcgctcgcaggagcgaccccgaagccagagccagagccagagcaggtcataaaaaactacacggaagagctgaaagtgcccccagatgaggactgcatcatctgcatggagaagctgtccacagcgtctggatacagcgatgtgactgacagcaaggcaatcgggtccctagctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggtatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctg

SEQ ID NO: 3433 - DNA, 5073 bp, Homo sapiens
cgcgcacgcagggctagcctcgcccaggcctcctccctcacgccggccgcaggacgggcgcgcacgccaagtgacgctccgaggaggaagcgcagcccccttcccctccctcgctgcccctggcccagcgggagccccccctccccccagtgcgcctgtgcggaggccctcttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgagatgtgaactttgtccccataaggatggagctttaaaaagaacagataatgggggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgtt

SEQ ID NO: 3434 - DNA, 3858 bp, Homo sapiens
ggaggtttcactgcacaacaagatggcggcggcggcggcgagcggagctggcggggctgccggggccgggactgggggagccgggcccgcgggccgcctgctgcctccgcccgcgccggggtccccagccgcccccgctgccgtgtcccctgcggccggccagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagaggtacttggcaaataggtccaaaagacatacactggccatgaccaaccctacagctgagatcccaccggacctacaacggcagctaggacagcagcctttccgttcccgggtctggcctcctcacctggtacctgatcagcatcgctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgt

SEQ ID NO: 3435 - DNA, 1623 bp, Homo sapiens
cgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtttccagtttgtttcctcgtctcttccagacatttgttatcgctgtggtgagtctggtcatcttgccaaggattgtgatcttcaggaggatgttgaagcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactg

SEQ ID NO: 3436 - DNA, 826 bp, Homo sapiens
tttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggt

SEQ ID NO: 3437 - DNA, 606 bp, Homo sapiens
gactctcgcgagatccctactggctataaaggcagcgccccggagagctcttgcgcgtcttgttcttgcctggtgtcggtgctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaag

SEQ ID NO: 3438 - DNA, 429 bp, Homo sapiens
aaggggctcttgagggctcctgcacccaccagaatgtgcagagaagaggtcccaggtgggagccgagagggggctgagggcagatccccaagagagaagtaattggtgtgagagaggatctcaatttcttcgtgtctaaaatggggaaactgcagcgccacttaccctgcctagggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggt

SEQ ID NO: 3439 - DNA, 728 bp, Homo sapiens
aaagcgtggcagcgcaggcgcaagcgcagagagcggaggcggtggtggtggcggccgctggccagtgctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagc

SEQ ID NO: 3440 - DNA, 1146 bp, Homo sapiens
gggagtttcggaggcggtgaccgtgacgtagaaggtggagaccgcttcaccctgatcagggagtatcggctgcgggtgcgcaaggcgtccaggagtgacctggggctgtggagagcgacccgtggccttgtgtttcaggtacggaggttccggactggacgggcgtcaggaagtcacagacttgtcctctgatgtggccccgcccgccgccgcactaatctcttcggcgtcgtacccgtcggcccagctcgacccgccgcagccccggccccgaccgtggacactgggggtccccgagggcgctgcgacctcctcccgggtgaaatgaaacccgagggcagtcccccttaccgaccccattagagacgtatctgccgtgccaggggtctaggctccagaaacagggagtttaccacctaggatgacttcagtgactagatcagagatcatagatgaaaaaggaccagtgatgtctaagactcatgatcatcaattggaatcaagtctcagtcctgtggaagtgtttgctaaaacatctgcctccctggagatgaatcaaggcgtttcagaggaaagaattcaccttggctctagccctaaaaaagggggaaattgtgatctcagccaccaggaaagacttcagtcgaagtcccttcatttgtctcctcaagaacaatctgccagttatcaagacaggaggcaatcctggcggcgagcaagtatgaaagaaacgaaccggcggaagtcgctgcatcccattcaccagggcatcacagagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccag

SEQ ID NO: 3441 - DNA, 3007 bp, Homo sapiens; identical to SEQ ID NO: 2738

SEQ ID NO: 3442 - DNA, 2947 bp, Homo sapiens
agactgagtgctccggggagctgtcagtgtcaggctctgggagagaggaagtgatcgctcccggaggagcgcgagccgagcggccggcgcagcgtgagacagcacatcctgcccgcgccggccccgccaccttcgggagccgcctgcaccaacgctgccgccgcccaggagccgccgccggctcggggagcccagttccgccgctgccgagcgcgtccaggaaaccaacatgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcagtgagcactcccagtgaagctggaagccaagactcaggcgatctggggccattaacaaggaccctgcagtgggacacagacccctcagtgctccagctgcagtcagactcagaacttggaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggttccaacagcaagtgtggccattgagggggcatccgccctaaaccgtgttcgttgggcccaagctggcaaagaagttgctgttggggactcggaaggccgtatttgggtctatgacgttggagagcttgcagttccccacaatgatgaatggacccgatttgccaggacccttgtggaaattcgtgctaacagagctgatagcgaggaggaaggcactgttgagttatctgcctagtggaaatgagccacccccactgcagcccccacctttgtgtcctagagctcagcgtctgcagtcaagtctcttgtattcggtgtccattcagtatcagtattgctgtgatattttgggtgccatattgtgccagctttgctccaagtattctaaatgtgtcccatcatgctttccactgacccaaaattcaccacagcatttctatctttatatttctgtctcaaaaatgaagagaagggggttatgggttaagttgctgccttttaactactttgtagctgtatttaatagctggaaacctctggttaaatttgtgcttacatgcactcctggcatagtcctattaaatccatatgaagccagatatgattgggtgcagatgtggtgttcctcatattatggtacagggccaaagacttgagacgtggtgttttacatggtgactcacattatgaatggatttactagaagaacattgctgctccttatttattgtagtgtgctgcatggaacgtatttatttgaaagcattaaaataaatgatcctagagcatgtgcataatgagaggactgtattctctctgctgctgttgaggttatattaagttccacatagcaattacagtatgccagttccactgaagacatgaaatctttagaggtttcttgcagtgaacgaaatgaattttaatgcctattatttctgggtactttaacaatatttcaaatatcattgaccactaatacttctcactgaagctaacacagtctgacaaaagtctatggttcctaaatatgacatcagtgttgccaataaaatgtttcaaacca

SEQ ID NO: 3443 - DNA, 4031 bp, Homo sapiens
acaccctcgcggagagagcggttcttgcagcatcctgcgcagcccctgcccagtttggtgcagaggcgtggggggcgggacgcgtctttgccattctgatagcggggaaagcggtgagaatcgaagtgaggagccgccagaggagagctgaggagaggagggggaggtcgacgacctgggccctgggcctctgaaggtctgtttctttctaggttcctgtagagatctgtatgtagctgttcacttggaagttaattaagaaagaacaaaaactattcatttggattcaaggtccatctccactggtggctgtggtggctttggattgttggaagaccatcaccttcagcaggtctgcacttgggaacaatcattctcccccagcccgagcgtgcctctgccctctgtatcattgacagaggctgtatgtttggaaagagaactttgtgactgcagaactgacagttgactctaattcttgctaccaagtttttccccgacccagtgaaagagtgttaagacttcgacctaggacacattgagaaccaaggccaagactggacagggccatataactgggcttcaaccatggctgggactaagaataagacaagagcccaggccaaaactgaaaaaaaggctgctatacaagctaaagctggagcagagagggaggctactggtgttgttaggcctgtagccaagaccagggccaaagcaaaagccaagacagggtctaagacagatgcagtagcagagatgaaggcagtgtctaagaacaaggttgttgctgagacgaaggaaggagctctgtcagagcctaagactctgggcaaagccatgggagatttcactcccaaggctgggaatgagtccaccagctccacatgtaaaaatgaggctggtactgatgcctggttctgggctggggaagaggccactatcaattcctggttctggaatggagaagaggctggtaatagtttcagcactaagaatgataaacctgaaattggtgcccaggtctgtgctgaggagttggaacctgcggctggggccgattgcaaacctaggtcaggggctgaggaggaggaggaagagaatgttattgggaactggttttgggaaggagatgatactagttttgaccctaatcctaaacctgtgagcaggatagttaagcctcagcctgtgtatgaaattaatgaaaaaaataggcccaaggactggtctgaggtaactatctggcccaatgcccctgctgtaactccagctgtgttaggatttagatcccaggcaccatctgaggcaagccctccttcatatattgttctggcctccgctgaagaaaatgcctgttctttgcctgtggcaacagcttgccgcccttctaggaacactcgctcatgctcacagcctatccctgagtgtcgttttgattctgacccctgcatccagaccatagatgagattagacgtcaaatcaggatcagggaggtaaatgggattaagccatttgcttgtccttgcaaaatggaatgctatatggattctgaggaatttgaaaaacttgttagcttacttaagtcaactactgatcctcttattcataaaatagcacggattgcaatgggtgtccataatgttcacccatttgcccaagagtttattaacgaagtaggtgtagtgacacttattgaaagcttgctcagttttccttcccctgaaatgagaaaaaagactgtaattactctgaatcctccttctggggatgaaagacaacgcaaaattgaattacatgttaagcatatgtgtaaagaaaccatgtcatttcctttgaactcaccgggacagcaatctggattaaagatactaggacaactgactactgattttgtccatcactacattgttgccaattacttttcagagcttttccatttgctgtcctcaggaaattgcaaaaccagaaatcttgttttgaaactacttttaaatatgtctgaaaatccaactgcagccagagacatgatcaatatgaaggcattggcagcattaaaactcatctttaaccagaaagaggcaaaagccaatcttgttagtggtgtggccatatttattaacataaaggagcatatcagaaaaggctcaattgtagttgttgatcacttgagttataatacactcatggccattttcagggaagttaaagagattattgaaacaatgtaaaatgagccagagatagaacattttaagccatcttcaaactctagcaggctgtacattacagtgtacacattatacactgcatctttaacacagagtcacctgtgacaggctctaggtttgagctagactattttgggggtatcaaatgaatattataccttgggctgaaaatgtttgatttttatcttgtctagattggcatatttttaacattttacttaagatagcaaaccagttcgttttaagtaagctaacttgttcattagtatctgtggcttaaaatggcaaaaaagaaaatatccttgagtttgtaatctagttacagaagtaaggcatacacacacacaaagataacagtacctagagagagagtgtgtgtgagtgtgcgtgtctctgtgtgtgcacgtgcacgctcatggccaaatgtgcgcactctacataaaggaggcaggagttcctataggctatttaatgtaagagaaactatttttctcctgttccagctgtatcagatactcgttccgcaacacagaaatgactcagaatctcagacaaaatgtattatttgttcaattttaattttgctactacattcataactcttaaattgttaggctgtttcatttacatcaaagttatctcacaaaagagaaggcaggaaacgttttgtgagtgcctattctatgtcaaacactgtgttggcaccatattttacaagtttttttcctcttctcacagtgatcttgtgagttagttacttatatttttattagaactcattattctgggtaccctccaatgagaattagagaggttaaataccttttcctagattcccacagcaggaaggtggcatagctgttttgtctgacaccagaacccatctcaccacactgctttacagtcttcctgaaggacattttgaggtgggggggccttcaaagctcagagactggtttgaatggtttaattttgcaatggatcatgtccatgccaggtgttacaattcttaacttcctccaaattcgtgtgtccattagacatttggctacatctggctggaggtcaggagaaaattctgaggtaaatagatggattttatctggcagtgtcgaaaatagtaggagcctaaaactttgttcaatgagtaagatgtagatttggagtcatcagcaggggaaacttgttagatgtcctttgtatctttttctatccatttgtattttttctttcccaaagagctgaaatcattttataccctgaatttaaaaggtaattgcttttttcctccttgcgaaatcataccttaattttttttttttttttttttaccatttatgatttattctcctatgtgtcatatgaaaggccaaggggctttatcttttactagtaggcaagcctgggcatttctgcatttgtgccagctaacactacaaaatagacttaattagagaaatttagacccagaattgcagcttcaacaacacaaaacaggaaagctagaagaggttgctgtgtcaacctacaagatagtgattcttggaagttggtatggaccagaaagcattcccaggacatttaggctatggctgagttctctaagactcagggtgggaattataatccctggtctaagctgatatgaaagtttctatgtgtgaaaatatggagttatatgctttgagattttctgccagttaaactaaaacaagatcatactgtaaatgtttgtaacttgcttccccccactgtatactgtaaacatctttgcatgtcaataaatatgcctctacaac

SEQ ID NO: 3444 - DNA, 833 bp, Homo sapiens
attctcatccctgtgctcagagctctcaagcacccacgatggccttctcaggccgagcgcgcccctgcattatcccagagaacgaagaaatcccccgagcagcccttaacactgtccacgaggccaatgggaccgaggacgagagggctgtttccaaactgcagcgcaggcacagtgacgtgaaagtctacaaggagttctgtgacttttatgcgaaattcaacatggccaacgccctggccagcgccacttgcgagcgctgcaagggcggctttgcgcccgctgagacgatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcggacaggaaggatctgactgccgatgcacaggagctgaaaggggagctatactgcctgccatgccatgataaaatgggggtccccatctgtggcgcttgccgacggcccatcgaagg

SEQ ID NO: 3445 - DNA, 660 bp, Homo sapiens
aggtgaggaggtgacccgcgggaatgtgtggggaaggagaatggaatctaattttaatcaagagggagtacctcgaccatcttatgtttttagtgctgacccaattgcaaggccttcagaaataaatttcgatggcattaagcttgatctgtctcatgaattttccttagttgctccaaatactgaggcaaacagtttcgaatctaaagattatctccaggtttgtcttcgaataagaccatttacacagtcagaaaaagaacttgagtctgagggctgtgtgcatattctggattcacagactgttgtgctgaaagagcctcaatgcatccttggtcggttaagtgaaaaaagctcagggcagatggcacagaaattcagtttttccaaggtttttggcccagcaactacacagaaggaattctttcagggttgcattatgcaaccagtaaaagacctcttgaaaggacagagtcgtctgatttttacttacgggctaaccaattcaggaaaaacatatacatttcaagggacagaagaaaatattggcattctgcctcgaactttgaatgtattatttgatagtcttcaagaaagactgtatacaaagatgaaccttaaaccacatagatccagagaatacttaaggttatcatcaga

SEQ ID NO: 3446 - DNA, 1375 bp, Homo sapiens
gtacaacttccggctgtaaagatggcggcttcctagtgagtcggcggctgatttagaaggaggttcaggctacggtgagccgaagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaacatcagtggggcctcacctgcccgccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgtt

SEQ ID NO: 3447 - DNA, 3478 bp, Homo sapiens; identical to SEQ ID NO: 986

SEQ ID NO: 3448 - DNA, 6344 bp, Homo sapiens
atgtctgagagccccaaggacgagggctccgaagagtgtctgtttctgcagcgcctatgggagtggggggcagtggggggaactcagggaagctgcctacaacttgaggccttccccaggctggaggaggaggacagggaaggccgaggggagctgtcctccggctgccatcaccctgatgaggcggccctgccccgggctgtggtctccgcaggggctggcaaccttgcctttgtccagctctctccgtggccaggcctgccatctgcctgcccacactcctccccggcaaagccccttgcaaatgcttgctttggggactggcagctttcgcctctgaatcaggacctagcatcagtactctggggagggggtccaggtgccaaccctgtgagtccctccctgtcccctgacgctgagaaggccctgccaacccccaccatgtgtgaggtgatgcccacaatcaatgagggggaccgcctgggtccccctcatggcgccgatgctgacgccaacttcgagcagctgatggtgaacatgctggacgagcgggagaagttgctggagtctcttcgggagagtcaggagaccttggcggccacacagagccggctccaggatgccatacacgagcgggaccagctccagcgccaccttaactccgccctcccccaggaatttgccaccttaacccgggagctgagcatgtgtcgggagcagcttctagagcgggaggaagagatatcagaactgaaagcagaacggaataacacacggctgcttctggaacatctggagtgcctggtgtcccgccatgaacggtcactgcggatgactgtggtgaagcgccaggcccagtcaccttcgggggtctccagtgaggtggaggtgctgaaggccctcaagtcactgtttgagcaccacaaggccctggatgagaaggtgcgagagcggctccgggcagcgctggagcgagtcaccaccttggaggagcagctggcaggtgcccaccagcaggtgtctgccctgcagcagggggcaggggtgcgggatggagcggcagaagaggaggggactgtggagctggggccgaaacgcctgtggaaggaggatacgggccgggtagaggagctgcaggagctcctggagaagcagaactttgagttgagccaggcccgggagcgactggtcaccctaacaacaaccgtgactgaactcgaggaggacctgggcacggcccgccgggacctcatcaagtcggaggagctgagcagcaagcatcagcgggacctccgggaggctctggcccagaaggaggacatggaagagcggattactacactggagaagcgctacctggctgctcagcgtgaggcaacatccatccatgacctcaatgacaagctggagaatgagctggccaacaaggagtccctgcaccgccagtgtgaggagaaggcccgacacctgcaggagctgctggaggtggcagagcagaagctgcagcagacgatgcgcaaggcagagacgctgccagaggtggaggctgagctggcccagagaattgcagccctcaccaaggctgaagaacggcatggcaacattgaggagcacctgcggcagctggagggacagctggaggagaagaaccaggagctggcacggacggctgtgcaggtgcgccagcgggaaaagatgaatgaggaccacaacaagcggctgtcggacacagtggaccggctgctcagcgagtccaacgagcgtctgcagctccacctgaaggagcgcatggctgccctggaggagaagaacacgttgatccaggagttggagagctcccagcggcagattgaggagcagcaccaccacaagggccgcctgtctgaagagattgagaagctgcgccaagaggtggaccagctgaagggccgaggggggccgtttgtggatggcgtccactccaggtcgcacatgggcagtgcagcagacgtgcggttctccctgggcacaaccacacacgcacccccaggcgtgcatcgccgctactcggcattgagggaagagtctgccaagctggccctgcctttgacagtgaccctgagatctccgacgtggatgaggatgagccagggggtctgctgcaacttagagtaccacagttcagggaccctctgtgggtcatcaggcccgctgccagtgccggagatgattcaggaagagaaggagtccacggagctccgcgcggaggagattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctgcccagtgacttaagaaagcataggaggaagctgctgtcgccagtgtctcgggaagagaaccgagaggataaagccaccataaaatgtgagacttctcctccttcctcacccaggacgctgcggctagagaagcttggccacccagccctgagccaggaagaaggcaagagtgccttggaggatcagggcagcaaccccagcagcagcaacagcagccaggactccctgcacaagggcgccaagcgcaagggcatcaagtcgtccattggccgcctgtttgggaagaaggagaagggcaggctgatccagctgagtcgggatggagccacaggccatgttctgctaacagactccgaattcagtatgcaggagcctatggtgcctgccaagctggggacccaggcagagaaggaccggcggctaaagaagaaacaccagctgcttgaagatgcccgcaggaaaggaatgccctttgcccagtgggatggtcctactgtggtctcctggttggagctctgggtggggatgcctgcctggtatgtggcagcctgccgggccaacgtcaagagtggtgccatcatgtccgctctgtcggacacagagatccagcgggagatcggcatcagcaatgccctgcaccggctcaagctccgcctggccattcaggagatggtgtcattgaccagcccctctgccccacccacctccaggacttcttctgggaatgtctgggtcacccatgaagagatggaaactctggaaacatctactaaaacagacagtgaggagggcagctgggctcagaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggcacgccaagtgatggaaagagagttcaataacctgttggccttgggcacagaccggaagctggatgacggggatgacaaggtgtttcgccgcgcgccctcctggaggaagcgcttccggccgcgggagcaccacggtcgcggcggcatgctcagcgcttccgcggagaccctcccggcgggcttccgtgtgtccaccctggggaccctgcagcccccaccggccccgccaaagaagatcatgcctgaagctcactcccactatctctacggacacatgctctccgccttccgggactagccatggcccccagggctggcttcctccttctgggtttcacaggctcctctggccctgacccctcttgctcgttccccttccttccgcagctcctagtctcgtccgtgactttccggttgccctggatctcagaatatattcgtccaccccctcggcaccccattaccccgagtcccaccgtgtgtccgttgtaagtccggtggatgtggctggggtttcctggtattgtggaggcacccaggttgtccatgcttgggattctgggggaaggagagaagggcagctcagggtggatgtgaagccacccttcctcttctggacccagcctggtctgcactgcaacctccaccaggaccaggatcctgggccacaggctgggatggtccttccaagaaagggtcatttcagacgcagccctgcttgggctattcaatcttagggtgtctatccacgtctggctgtgccaaatggtctggcagctggttttggcatccccagcatcaccactctcccaacccatcaccgtgactgcagttcctgcccccattctcttggggtcagggaggggctgggaagggctactgaaggccccattctcccacaggatggtgaggctgggaggaggaagactgaggtagagattccaggccctggcataagctgaatcccaaatttgagtttgggaagaaccagagagaaatggatccctgagctctgagccaagggtgaggatggggaaactctaagctcccacctaataagaagcataggcagaccagccagagggagagccaatggcctctggtagccttaagcccaaagggcagtgggaatgtcccctgccccaaccatcgggtggagctcctgctgggctatggggaagggaggttgtgcggatcttgactctagggcagaacagatctaaccatgcattgctagctctgctcccagcatcccttccccttctctcctcctctgcctcacttctttagtaatcccaaccctataaaaatgaacctaatgggtggattgaatatacattgagcccaaagtcaagtttggggaaaaggcagactaaggcctcctttctctgacctcccaggaagaaaatagcttctcctacagtgattcatgtcccaggtccaggaaatccaatgttggtgaaggcagccactctcttgcttgtccccaaatcacctaaccctcatccagggctattttggtgggcagggactgcctcctcccggaattcctaagatccgcccagctgccaccattttcattgctttccccagcagcatgatgggaacccaagctgagggatacaggtcctgatttggtaggaatattattcccaagaaatacccgctcctcacctactccctcatcctaccaaggtgcctgaaaatgttcaagacttatgttcagggtgggatgatggaaccgagggcttcatcaaagtgagaggaaaggaaaagcatctggcatgtgtttcttggataggggccagtgcagtgccatcctacaggtggctggagcagctgctttgcaacctgatcaccttgagttctgagcagggactaggcttgcaggtgagataatgggccagggcacccagtccagaaggagcaatggcacctgggcagtgccagggcttaaagcccgctgctccttttcggtagaggagaggcccatcactggtgtggtggggtgggctctcccttaggcttgggcaaggcagccacctgcccttgctctcccttagtgttccctggcctccctgccatcaggttgctgggagtggagatggagggattattgagcagaaaatgagttggatggagataaacagctcccatccctgggtaatggatggtaagatgatggagattcctaagattggtggagttgggcaatgcatagccatctgactccttcagggtgctcttgatgggctggctgtaagggagactcagtcccagcctctcccctctacaactcctgccactgttggccatgtcgtaaggcagcagctgtgccaggatagctgggtccattcagagcaccttgagaagtgttgcagggaggtgttaagaagagaactctgtgcaaacagtgatggaaggctgttgtcttggtgtatcccttgcctcatagtcaatatattttttttttggcgagtcaccagtgacccgagccctccacaccagcctcctgtatctcatcaggtcccttctcagtactgtatttgctcagtgcatcaggaatgggtgtatgggtgtgtgtgggtgggtgtgagtgtgggtgtgtacgtaccaataaacaacctggttttaagacaatgt

SEQ ID NO: 3449 - DNA, 2317 bp, Homo sapiens
gctttttgccatcctgggcgctagagggaattgcgctgcaattcattaaattgcctctcagtctcaacagatgacaaaccccttgcccttgcctctgatttaagagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaaggtaaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagcattgtc

SEQ ID NO: 3450 - DNA, 1241 bp, Homo sapiens
gggtctggtagattatcctgatgatgatgaagatgatgatgaggatgaagataaggaagatacgttaccattgtcaaagaaagcaaaatttgattcataataatggcaacggcctaggatcagtacctgttgaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataacctaacgttgtgctggtacctgttttaccatgtgtaatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgacttttgaataataaaaagaaaagtgaagagtaag

SEQ ID NO: 3451 - DNA, 765 bp, Homo sapiens
cggcgggggcgacccgggtgccggcccgtgcgggcgacacgcgcgtctctgcggggctgcgcggggtccggagcggctgggggctctctgccgggcgcggctgggcgcggggggcgctcccggccgggatgagctcaccgcagtcgcgccggggctgagcgccgagcggggcggcggcggggcgggcggcggctcctcggcggctccgcggcgcccgggccgcgcgccgccatgctgggcctggacgcgtgcgagctgggggcgcagctgctggagctgctccggctggcgctgtgcgcccgagtcctcctggctgacaaggagggtgggccgccggcagtggacgaggtgttggatgaggctgtgcccgagtaccgggcgccggggaggaagagcctcttggagatccggcagctggacccggacgacaggagcctggccaagtacaagcgggtgctgctggggcccctgccaccggccgtggacccaagcctgcccaatgtgcaggtgaccaggctgacactcctgtcggaacaggctccggggcccgtcgtcatggatctcacaggggacctggctgttctgaaggaccaggtgtttgtcctgaaggaaggtgttgattacagagtccacagggagattgtcagcggcctcaagtgtctgcaccacacctaccgccggggcctgcgcgtggacaagaccgtctacatggtgggcagctatggcccgagcgcccaggagtatgagtttgtgactccggtggag

SEQ ID NO: 3452 - DNA, 1604 bp, Homo sapiens
acatgggaggaaaattcagtttcagctcagctagggatttagtcttactaaagacgcgggaggaagttctccagcgagcagctttccccaacgtggaaaggaccacgcaaggacacctgagctttccaacagatgttcagcgccaggggatccacagttctgggaggtgatctctgatgaacatgccatcgactccgctggcacctaccacggggacagccacctgcagctggagcgcatcaacgtgtactacaacgaggccagcggtggcaggtacgtgccccgcgctgtgctcgtggatctggagccgggcaccatggactctgtgcgctcggggcccttcgggcaggtcttcaggccagacaacttcatcttcggtcagtgtggggccggaaacaactgggccaagggacactacaccgaaggcgcggagctgatggagtcagtgatggacgttgtcagaaaggaggctgagagctgtgactgcctgcagggtttccagctgacccactccctgggtggggggactgggtctgggatgggtacccttctgctcagtaagatccgggaggagtacccagacaggatcataaacacattcagcatcctgccctcgcccaaggtgtcggacaccgtggtggagccctacaacgccaccctctcagtccaccagctcatagaaaacgcagatgagaccttttgcatagataacgaagctctgtatgacatatgttccaagaccctaaaactgcccacacccacctatggtgacctgaaccacctggtgtctgctaccatgagtggggtcaccacgtgcctgcgcttcccgggccagctgaatgctgacctgcggaagctggccgtgaacatggtcccgtttccccggctgcatttcttcatgcccggctttgccccactgaccagccggggcagccagcagtaccgggccttgactgtggctgagcttacccagcagatgtttgatgctaagaacatgatggctgcctgtgacccccgtcacggccgctacctaacggcggctgccattttcaggggtcgcatgcccatgagggaggtggatgaacaaatgttcaacattcaagataagaacagcagttactttgctgactggctccccaacaacgtaaaaacagccgtctgtgacatcccaccccgggggctaaaaatgtcagccaccttcattgggaataatacggccatccaggaactcttcaagcgtgtctcagagcagtttacagcaatgttcaggcgcaaggccttcctccactggtacacgggcgagggcatggatgagatggaattcaccgaggccgagagcaacatgaacgacctggtgtctgaatatcagcaatatcaggatgccacggccgaggaggaggaggatgaggagtatgccgaggaggaggtggcctagaactctccttttctaggtaaaggggggaagcagtgtggattctttactgtgttctgacagccatgtgtcactatacgcttgttaatttgtgtcttcacatctcctgctgcgttttaaagcatttttatagtatgcggttttgactaataaagtattctcacagcatctg

SEQ ID NO: 3453 - DNA, 1299 bp, Homo sapiens
gttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagagtgagccaagggccctggggacctgcctgacttggggctcacctgcgtggcagcgtggcgggttatgtgcaacaaatgctgttgccttttggggagagggggcagtaactgggaagtgtgtcgtgtgggctgccctgccctgctgtttgggggccatgcccagactgaagccatgagcagcgccttcccccttaaactcaaagctgtgccaagtagctggtgaacagcagtgcccgctcagccgccttgtggctggcactttggtttgctctccaagctccggttcccattagttgttgcggagcctgaggcccaacccagggcttcctcccagtgctgatcctcgtgccaggcttctggttcactggggccaggggcccctcatggttgcctgggtgccagcaggggctgggcagagagatccacaggcccaggctgatctcttccctgctcagaggtctttccagtccagatcgtccaagctgcgtccagtggctcctggaggagtcagtgggtactgtggcctggcgcctggtagctggccgtttggtgccaagtgaccttgtccttgctgtgggcgtggctgccccagcagcctttccaacacggttgggagccgagcctgtggcaaagaggcccatgccccttggttgcctgagggtccgtgctctaccgctctgcccaaatgggtgcagtcagatgaaggagacagaaggccagggccgatgtcaggtggaccagtcctttcttaggt

SEQ ID NO: 3454 - DNA, 582 bp, Homo sapiens
aacagaccgccgtgagagaggaggggcgccggccgggattcgcggcccggagctcgggaccggagtcaggaatggagagaagggtaatggttttacctcttattgtggaaacctgttgagatcacagagaatatactgacggcataaaagggcagaaccatagcagggtgcgaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtg

SEQ ID NO: 3455 - DNA, 4208 bp, Homo sapiens
gtgggaaacctaacgtcaaagtctacgtaggaagtcgtagggaaggcagcgaggaagacgctggctctcgggtcacgtgatgcgccgggagcgtcatcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtcaattatattccagaagtgagaatcatgtcaattcccaaccttcgctacatgaaggagagccaggtcctcctgactcttacaaatccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaaaaggttccactggagggcagatcccaaaggacagtatcaccgtaaacctgcgttaaaatgtggaagctgctgcttcattaggccttgtttataacgatgtacccatgcactacggaattctattgctaagaaagtgggagcataggcaaggcattgggaacacagggtagctgctgttgctcttgctctcacccctgttgacaccagtaagtctgtgtctccctcactgaaccctgcacgttgagtaacagcagcataattccatcctaggaaaggggatgggtgttccttggaatggcattgtatttaccacctgagaaactctgtactgtctcttgatctgatctcactaaggatcacaatgtcacagatgaaacttaaatgataacccaaaggtagacctgctgttaatgatccagcattggtcacaatgtaccaactgctttctgcattccgttaaatatcatctaacagtctaaaacatatcccttcattgccataatggctgccattttgccatagatttccatataactgaaaaactgaattgtcactttatctttagtatcatgatgattggaaaaacctgtgaagttgttaaggcactctcatttgccctctttttctaagtgaatacaggacacgtattagttgttcttaatttttttcccagtaaaatatggatcttttaagaagaatttgagaagcaaacaattacatgtcatgtcaagggggtagcagattccattcgttttcaatattgccacaatacccagggattaatgctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttgtttaccttggtcttgttttaagtcttaaaaaattaaagataacattataatgtagaatacagatgggacatagtccttgtaagcttcccttgaaaatgttttaaatatttaggaagcttttaaaagacactaaattgtactctaaaagacactaaattgtactaattgtacaaaggtcaagccaattttatgaaacagtcctacagagtaatatatgtgatgcagtgtaagaaggaaaatactcatctctaacattatggtaataacatttagcctcttaggagttggagcagggggatgggtaattacagatttgcagactatagaaagagtttcatttttttgtgaccccacagagtctcaaatttttatttcactacctgctagagcctactgtgaaatcactgctccatatttgccagtggaggaaatgggcatagagtagagaatagcttcatatgtttacacgtttgcatagactacacacatgtcatgcgtttatggcaggtagctggtatttattccccaaagtaataatgttgaagtatgggtctcatcattcccatacacagaaacacaaaacactttgatcataaacttttttcttcagaagccaaactaacttgcagaataatagagccactggtttaatgtttcctcaagataggttttagtgtaagctagtattctgtgtgttcgtagaaatgattcaatacctgcagctggtgaattaggaattgtatttgttgccttttttatattagatgaggtgcaaaaattttaatgctagtcagtatgcaccaccacaggaaagttagatcccattagcacttgaaactacagctttggaaacttaggctaagttaatttggatttgttacttgattcacctactgaccttttcttttgtttgaagtgcttatcagcataatgagctaagtgtcatgcatatttgtgaagaaacaccctttttggtcccttttgggacagagaggtactccttgatctttatgaatgacaggttactgttttgccttattgcttaacttaatgtagtgaaataaagcagacaaagcttgagcgtgtcttttgtttgctctcatgtagatactaagtagcatggctcagagccaaaagacaagcgtgaagttaagagagttggctaagagagttggtggggcatgctcccttccattccttaaatgaagtaatctaaaatctcttagcaggttagttcaccataatatataagtagatgttgctttgagcttcttatatacatattcacagaaccattatataaatgttgttagacctctaccagtttttatcctgggtcattgcttctaaagatatcctttacaatatacacagtggtctgactcca

SEQ ID NO: 3456 - DNA, 6310 bp, Homo sapiens
gccacagggacagccggtgggctcggtggggctgcagaaggtcggggctgcactgctctcggcccccacacggttggttggttggcgtggtaagtgccctgatccctggtcctgagaactcaggctggcacagggattcccagggcatctaccaccacgcagctggagcagggctgagcccaggagcatggagatggacgcccccaggccccccagtcttgctgtccctggagcagcatcgaggcccgggaggctgctggatggggggcacggcaggcagcaggttcaggccctctcttcacagctcctggaggtgatccccgactccatgaggaagcaagaggtgcggacgggcagggaggccggccagggccacggtacgggctccccagccgagcaggtgaaagccctcatggatctgctggctgggaagggcagtcaaggctcccaggccccgcaggccctggataggacaccggatgccccgctggggccctgcagcaatgactcaaggatacagaggcaccgcaaggccctgctgagcaaggtgggaggtggcccggagctgggcggaccctggcacaggctggcctccctcctgctggtggagggcctgacggacctgcagctgagggaacacgacttcacacaggtggaggccacccgcgggggcgggcaccccgccaggaccgtcgccctggaccggctcttcctgcctctctcccgggtgtctgtcccaccccgggtctccatcactatcggggtggccggcatgggcaagaccaccctggtgaggcacttcgtccgcctctgggcccatgggcaggtcggcaaggacttctcgctggtgctgcctctgaccttccgggatctcaacacccacgagaagctgtgtgccgaccgactcatctgctcggtcttcccgcacgtcggggagcccagcctggcggtggcagtcccagccagggccctcctgatcctggacggcttggatgagtgcaggacgcctctggacttctccaacaccgtggcctgcacggacccaaagaaggagatcccggtggaccacctgatcaccaacatcatccgtggcaacctctttccggaagtttccatctggatcacctcccgtcccagtgcatctggccagatcccagggggcctggtggaccggatgacggagatccggggctttaacgaggaggagatcaaggtgtgtttggagcagatgttccccgaggaccaggcccttctgggctggatgctgagccaagtgcaggctgacagggccctgtacctgatgtgcaccgtcccagccttctgcaggctcacggggatggcgctaggccacctgtggcgcagcaggacggggccccaggatgcagagctgtggcccccgaggaccctgtgcgagctctactcatggtactttaggatggccctcagcggggaggggcaggagaagggcaaggcaagccctcgcatcgagcaggtggcccatggtggccgcaagatggtggggacattgggccgtctggccttccatgggctgctcaagaagaaatacgtgttttacgagcaagacatgaaggcgtttggtgtagacctcgctctgctgcagggcgccccgtgcagctgcttcctgcagagagaggagacgttggcatcgtcagtggcctactgcttcacccacctgtccctgcaggagtttgtggcagccgcgtattactatggcgcatccaggagggccatcttcgacctcttcactgagagcggcgtatcctggcccaggctgggcttcctcacgcatttcaggagcgcagcccagcgggccatgcaggcagaggacgggaggctggacgtgttcctgcgcttcctctccggcctcttgtctccgagggtcaatgccctcctggccggctccctgctggcccaaggcgagcaccaggcctaccggacccaggtggctgagctcctgcagggctgcctgcgccccgatgccgcagtctgtgcacgggccatcaacgtgttgcactgcctgcatgagctgcagcacaccgagctggcccgcagcgtggaggaggccatggagagcggggccctggccaggctgactggtcccgcgcaccgcgctgccctggcctacctcctgcaggtgtccgacgcctgtgcccaggaggccaacctgtccctgagcctcagccagggcgtccttcagagcctgctgccccagctgctctactgccggaagctcaggctggacaccaaccagttccaggaccccgtgatggagctgctgggcagcgtgctgagtgggaaggactgtcgcattcagaagatcagcttggcggagaaccagatcagtaacaaaggggccaaagctctggccagatccctcttggtcaacagaagtctgacctctctggacctccgcggtaactccattggaccacaaggggccaaggcgctggcagacgctttgaagatcaaccgcaccctgacctccctgagcctccagggcaacaccgttagggatgatggtgccaggtccatggctgaggccttggcctccaaccggaccctctccatgctgcacctgcagaagaacagcatcgggcccatgggagcccagcggatggcagatttgaagcagaacaggagtctgaaagagctcatgttctccagtaatagtattggtgatggaggtgccaaggccctggctgaggccctgaaggtgaaccagggcctggagagcctggacctgcagagcaattccatcagtgacgcaggagtggcagcactgatgggggccctctgcaccaaccagaccctcctcagcctcagccttcgagaaaactccatcagtcccgagggagcccaggccatcgctcatgccctctgcgccaacagcaccctgaagaacctggacctgacagccaacctcctccacgaccagggtgcccgggccatcgcagtggcagtgagagaaaaccgcaccctcacctcccttcacctgcagtggaacttcatccaggccggcgctgcccaggccctgggacaagcactacagctcaacaggagcctcaccagcttagatttacaggagaacgccatcggggatgacggagcgtgtgcggtggcccgtgcactgaaggtcaacacagccctcactgctctctatctccaggtggcctcaattggtgcttcaggcgcccaggtgctaggggaagccttggctgtgaacagaaccttggagattctcgacttaagaggaaatgccattggggtggctggagccaaagccctggcaaatgctctgaaggtaaactcaagtctccggagactcaatcttcaagagaattctctggggatggacggggcgatatgcattgccacagcactgtctggaaaccacaggctccagcatatcaatctccagggaaaccacattggggactccggggccaggatgatctcagaggccatcaagacaaatgctcccacgtgcactgttgaaatgtgatcctggtggacggatcaggagaatgggcagatgctcagctggaagcttttgaacagaaaggccgacttctggggggcctgtctgggagctgggaacgctgcttgctcagcacgagagccgggctctgcagggaggaaggagaggtgctgccggaggaggtcgtgagctcctcttctgctgcaggagtggtccaggcagggggtgacgggtactctgttatggcacagagaagggaggggccacccccaagggactaggggccaaaggcctgaaagctgagcagtacaggaggctggttccagctttacaccctgaggacttcatgtgtccccaacctttaaaaatgtttattactgcccctttccactcacctggttaaaaatcatcccatgctctgagatgagctgccacctcaagcccgtgaggagcatccgtttggtaggggtaacagaggggacccttctttatcttctcaagaagaagatttcagggtatcatccttacagacatgaaaaagctatgggaaaattgtgaagataaatgaaagttttaattctaggattctggaaacagagacagtaagagttctccaaggattttgccttttttgtttgtttttgagatggagtctcgctcttgtcgcccaggctggagtgcagtggcacgatctcagctccctgcaacctccgcctcccgggttcatgtgattctcctgcctcagcctccccagtagctgggaatacaggcacccgccaccatgcccggctaatttttgtagttttagtagagacggggtttcatcatgttggccaggctggtctcgaactcctgacctcaggtgatccatcagcctgggcctcccaaagtactgggattacaggcatgagccaccacacctggccccattttttatttattacaaaatcaaagacatgggtgatgcctggcacatgttgtctggagtctggcacactggttatcaatagcacattcagtgtattcagtgatgtcattctttatttatttttgagacagaatctgtcacccaggctggagtgcagtggcatgatctcagctcactgtaggctctacctcatgggttccagtgattctcctgcctcggcctcccaagtagttgggtctacaggcacgcaccaccacacccagctaatttttgtatttttagtagagatggggtttcaccatgttgatcaggctggtctttaactcctgacctcaagtgatccacccacctcagcctcccaaagtgctgggattacaggtgtgagccactgcacctggcagtgatgtcattccttactaggcttccaaagccactgctgtggccacagcttccatggagacaggcaagctgagcctctatgtggcaccaattcctgcagctgtttgtgttggagggaaaaaaatccaaatggacatcaacagctttcatcaactaaataaccacagaaaatatttatgaagactataaagcaatgattacttttgaattggaaaggaatcactattatttgaaatgtttcttcaaaagtgagcatccggacaggaaccatcatggatgctgaggccatggatgaaggcctactcgggaagatgatatccttgcagtctcaaaacggcaccccacaaaggtgatatcctaatttacaaagggaaaaaggtaccttaatctgaaatctggcaaatgcagcctcaacagaagtgacagaattgaacatcgccaataatgggacacacagacatcacatgcccccagtctgatgcaccacggagtcgtctctgatgtattcttgtcaaaaaatgtttgcctgattctaatcatgaaagaacaattagaaaaaatccaaattgacagatattctgcagaataaatggcctgacctcatcaaaaacatcaatgtcatgaaaaacacaaaacattgcagatagcgtgaaattaaagattacagagatataatttaatgcaagatctctgactggatcctagactgcaggaaaaagtctgctataaagaacatttggatcacttgtagtagctgggaaataaaacaaaacattatttgtaaaaggggggaaatctgaacatgggtcttgcagtatttatgacagtttttgcggggcagagatttctagattgacagctgttttagtactttcaaggtgatgctctgtctgctggtttgcattgtttctgtctgagttaagagactggcagaacacagagttgcagtagccaaacactggagaaagctgggccctacagaaacctaacgctgaagaaacctcaggagccaaactggtggagaaaacaaagagtcctccctctctcccttttcaaataatgatcatacatcttcaagctgtctgaaatggttaaggagttcagtctgtcgtcaggcacacaccagagccagctagcccacacagaccccatcagagcaaaacagacaagagaatttaattcatatccacatagaaaggacttctaggtaggaggtagaccctttagctcccttccaattaaaggagtccccaattctggcacctgagagtcccctgggtctaacagctatgatatttatgtagtgtgttgcttacctaaatgaatacaatttccttccagacacgtgacactgatattaaagtgctaatgagagggatctatttcttcttgtacgctaaaagagaaacagcagttcagatttcccatcagaagtccgaggactttgttcttgataactactaccaataaaaattgagtatttg

SEQ ID NO: 3457 - DNA, 2706 bp, Homo sapiens
gatgccaggcgagctgagctggggatgctggaacgaagggcgttgctatggcaacgggaggcagggcctggttggggggaccgggcccgggctgggaccgggggggccggcggtggctgtggtggggcgatggcggagcgcggcccggccttctgcggcctgtacgacacgtcctcgctgctgcgatactgcaacgatgacaatttgtcgggcacgagcggtatggaagtggacgaccgcgtgtcggcgctggagcagcggctgcagttacaggaagacgagctggcggtcctaaaggcggcgctggcggatgctctgcgtcgcctgcgggcatgcgaagaacagggagcggcgctacgcgcgcggggcacccccaagggccgggcgcctccgcgcttaggcaccactgcctcggtgtgtcagctcttgaaaggccttcccaccaggacgccccttaatggctcgggacccccgcggcgcgtgggtggctatgccacgtccccatcctctcccaagaaggaggcgacctccgggcgcagcagtgtccgccgctacttgtcaccagagcgcctcgcctcggtgcgccgtgaggacccccgcagccggaccacatcctccagcagcaactgtagcgccaaaaaggaaggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtac

SEQ ID NO: 3458 - DNA, 1916 bp, Homo sapiens
cactctgccctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagcatttaaatgtttccaagacaaattggaacaagaactactcaaatggaggagccaaggacagaaattgcaggtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttgg

SEQ ID NO: 3459 - DNA, 2200 bp, Homo sapiens
gacggccgcgcatgcgcccttggttggcgggagtttcggaggcggtgaccgtgacgtagaaggtggagaccgcttcaccctgatcagggagtatcggctgcgggtgcgcaaggcgtccaggagtgacctggggctgtggagagcgacccgtggccttgtgtttcagaaaaaggaccagtgatgtctaagactcatgatcatcaattggaatcaagtctcagtcctgtggaagtgtttgctaaaacatctgcctccctggagatgaatcaaggcgtttcagaggaaagaattcaccttggctctagccctaaaaaagggggaaattgtgatctcagccaccaggaaagacttcagtcgaagtcccttcatttgtctcctcaagaacaatctgccagttatcaagacaggaggcaatcctggcggcgagcaagtatgaaagaaacgaaccggcggaagtcgctgcatcccattcaccagggcatcacagagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttcatcta

SEQ ID NO: 3460 - DNA, 1780 bp, Homo sapiens
agcggaaaaccaattggtttaaaagaagagccagtaagttcatgactcacgtggcctcccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagctgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccaggacactggtgcgaatgacacaactcaagttgggaggggaacagggaaggaagggatggatgggggtggtgtatcttactctgtttaagcagaacaccttgtttgcggtgttggaacatggttcctttggcagaagtgctttttttttaatcgcagtactatttttataaagcaagaactattccatgccttggagaatgaatcatttttagattgtgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaacattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggaacagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctact

SEQ ID NO: 3461 - DNA, 558 bp, Homo sapiens
gaaatttgggttttaggacaggcgaaccaacccgctctccttcaagctcccggccatttcttggggcagagagctaggaggggtccgcggcagagcaaagcgggaaggcccaatgggcaggaagcctctccagccgcccccagcccggccggcccccgcacgccccagagcctcaattgacttggatttccttgagttcggtgtctagggagccaagtgttgggctgtggaaggtagatgaatgctccagggatagagacctgtatcagggtgccatggagatggagagcgcggcggcctccacacgtttccaccagcctcacatggagaggaagatgagtgcgatggcctgtgagatcttcaacgagcttagactagagggcaagctctgcgacgtggtcatcaaggtcaatggctttgagttcagtgcccataagaacatcctctgtagctgcagttcctactttagagctttgtttacaagtggctggaacaacactgaaaagaaggtatacaacatccctggcatttctcccgacatgatgaagctaatcattg

SEQ ID NO: 3462 - DNA, 2062 bp, Homo sapiens
gtgtttcaccacacggagatgtggtcacgtgacttgtcaactttcacccaggatgtctcccttctgacttccccttagcaaccaagtcgcggcgcttggttccccagcaaccgggagacgcgtctgctgcgtggaaccgccgagttcccagcgcttgagaaggaaaattctggatctgttatctgtgaggaggccactccgttgacagttgtgtaaaactctgctgctttccccagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggaacatcctccgcatagacaacctctggcagtttgagaacttgaggaagctgcagctggacaataacatcattgagaagatcgagggcctggagaacctcgcacacctggtctggctggatctgtctttcaacaacattgagaccatcgaggggctggacacactggtgaacctggaggacctgagcttgttcaacaaccggatctccaagatcgactccctggacgccctcgtcaagctgcaggtgttgtcgctgggcaacaaccggattgacaacatgatgaacatcatctacctccggcggttcaagtgcctgcggacgctcagcctctctaggaaccctatctctgaggcagaggattacaagatgttcatctgtgcctaccttcctgacctcatgtacctggactaccggcgcattgatgaccacacaaaaaagcttgcggaggctaagcaccagtacagcatcgacgagctgaagcaccaggagaacctgatgcaggcccagctggaggacgagcaggcgcagcgggaggagctagagaagcacaagactgcgtttgtggaacacctgaatggctccttcctgtttgacagcatgtacgctgaggactcagagggcaacaatctgtcctacctgcctggtgtcggtgagctccttgagacctacaaggacaagtttgtcatcatctgcgtgaatatttttgagtatggcctgaaacagcaggagaagcggaaaacagagcttgacaccttcagtgaatgtgtccgtgaggccatccaggaaaaccaggagcagggcaaacgcaagattgccaaattcgaggagaagcacttgtcgagtttaagtgccattcgagaggagttggaactgcccaacattgagaagatgatcctagaatgcagtgctgacatcagtgagttgttcgatgcgctcatgacgctggagatgcagctggtggagcagctggaggagactataaacatgtttgaaaggaacattgttgacatggtaggactgtttatcgaaaatgtccaaagcctgatggctcagtgccgggacctggagaatcaccaccacgagaagctcctggagatctctatcagcaccctggagaagattgtcgagggcgacctggacgaggacctgcctaacgacctgcgcgcgctttttgtcgataaagatacgattgttaatgctgtcggggcatcgcacgacatccacctcctgaagattgacaatcgagaagatgagctggtgaccagaatcaactcttggtgtacacgtttaatagacaggattcacaaggatgagatcatgaggaaccgcaagcgcgtgaaggagatcaatcagtacatcgaccacatgcagagcgaactggacaacctggaatgtggcgacatcctagactagatgaatgtcagccacaggagcttcttcaaaacatagcaccagccccagccaggagaaggaagtgcacacgcctcacccgcacctctagagagttgctgggcatctctcaaccgcgatccccaacaccattcttcccccacccctggaaaaacttccaaaagtagagaaaataaaggactcatttcacatttcccctactc

SEQ ID NO: 3463 - DNA, 1332 bp, Homo sapiens
gcacaaattcgcagcaggcggctggggcggcggctggggcagcggctgcagcagcggcggacgctctgcattacccagtcttgcgtcctcggcaggcgcccgaagctgagtgcgcatcctctaccgcacccaagcttcgtctgtctcgtcaagctcttcatgctgcccaactaaaaggaaaacatgggcacaggggattttatctgcatttccatgactggaggggcgccctgggggttcagattgcaaggtggcaaggagcagaagcagcccttacaagttgcaaagattcgaaatcagagcaaagcctctgggtctgggctctgtgagggagatgaagtggtttccatcaatggcaacccttgtgcagatctcacctaccctgaagtcatcaagctcatggaaagcataacagactctctccaaatgctcatcaaaaggagagtgggcgctccctttctcttcctggaagatcagtcccaccccccatttctacatctccttgggtataccagcctacttatagttactctagtaaaccaaccgatggactagagaaagcaaacaagagaccaactccttgggaagcagcagcaaagtctcctctcggtctagtggatgatgctttccaacccagaaacatccaggaatccattgtggcaaatgtggtttcagcagctcggaggaaggtgcttccagggcctccagaggattggaatgaaagactgtcctatattcctcaaacccagaaggcctatatgggctcatgtggaaggcaagagtataatgtcacagccaataataatatgtccaccacctcccaatatggttcacagttgccatatgcatattataggcaggcttcaagaaatgattctgcaatcatgtccatggaaaccaggtctgattactgtcttccagtagctgattacaactacaacccacacccaaggggatggagacgccaaacatgaaagttagaagaacggatcatgtgccaactgtagttttttaaaaaaaacgctcctttgtagggttttaaacttttctaatagatttagattcacttttggtcttggcttgttctcataagtcatttatctaagtttgtgtttctgtgtgtgtgtgtgtgtgtgtatgtatgtgaatatacacacacacacacacacaggtgagtgtgaatacttccttgttggctgatccatagagcattacttggaagaaaatttcactatttgcattgatgtgctggcatttatatgtaattcataattttgattccattaataggtagtctatgcaacaaactctactcaattaaagtaaaactaa

SEQ ID NO: 3464 - DNA, 1445 bp, Homo sapiens
cgctcccgttgctaccggaatgcctcttcaggttagcgattacagctggcagcagacgaagactgcggtctttctgtctctgcccctcaaaggcgtgtgcgtcagagacacggacgtgttctgcacggaaaactatctgaaggtcaactttcctccatttttatttgaggcatttctttatgctcccatagacgatgagagcagcaaagcaaagattgggaatgacaccattgtcttcaccttgtataaaaaagaagcggccatgtgggagaccctttctgtgacgggtgttgacaaagagatgatgcaaagaattagagaaaaatctattttacaagcacaagagagagcaaaagaagctacagaagcaaaagctgcagcaaagcgggaagatcaaaaatacgcactaagtgtcatgatgaagattgaagaagaagagaggaaaaaaatagaagatatgaaagaaaatgaacggataaaagccactaaagcattggaagcctggaaagaatatcaaagaaaagctgaggagcaaaaaaaaattcagagagaagagaaattatgtcaaaaagaaaagcaaattaaagaagaaagaaaaaaaataaaatataagagtcttactagaaatttggcatctagaaatcttgctccaaaagggagaaattcagaaaatatatttactgagaagttaaaggaagacagtattcctgctcctcgctctgttggcagtattaaaatcaactttacccctcgagtattcccaacagctcttcgtgaatcacaagtagcagaagaggaggagtggctacacaaacaagctgaggcacgaagagcaatgaatactgacatagctgaactttgcgatttaaaagaagaagaaaagaacccagaatggttgaaggataaaggaaacaaattgtttgcaacggaaaactatttggcagctatcaatgcatataatttagccataagactaaataataagatgccactattgtatttgaaccgggctgcttgccacctaaaactaaaaaacttacacaaggctattgaagattcttctaaggaattctgttctcttgagggcattgaatgtcaggcctctgagcccaagctaagccatcatatccctagtgacctgcacgtatacatccagatggcctgaagcaagtgaagaatcacaaaagaagtgaaaatggccggttcctgccttaactgatgacattaccttgtgaaattccttctcctggctcagaacctcccccactgagcaccttgtgacccctgcccctgcccgccacagaataaccccctttgactgtaattttccattacctacccaaatcctataaaacggccccacccctatctcccttcgctgactgtcttttcggactcagcccgcctccacccaggtgattaaaaagctttattgctcacacaaa

SEQ ID NO: 3465 - DNA, 1021 bp, Homo sapiens
acatccgggtaccgactccagccgcctagacgctggcactatggtcatggcggaggggacggcagtgctgaggcggaacaggccgggcaccaaggcgcagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggtaaaattgctgctaaacaatcattggatcacaatcctcatcagacaaacccatctgtaaaaaaaatgagggagagcttgaggtttcacacaagccatttactaa

SEQ ID NO: 3466 - DNA, 1808 bp, Homo sapiens
gtttccggttgtcggaggcgaggcttgtcggctgtcaaaggggcggcccggcccggcccggaagctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatg

SEQ ID NO: 3467 - DNA, 3573 bp, Homo sapiens
agtgctcagcaacgattacgccccgagggccaatcacagggctgcggccgagagagaagccttattagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaatg

SEQ ID NO: 3468 - DNA, 521 bp, Homo sapiens; identical to SEQ ID NO: 1926

SEQ ID NO: 3469 - DNA, 614 bp, Homo sapiens
gtacaacttccggctgtaaagatggcggcttcctagtgagtcggcggctgatttagaaggaggttcaggctacggtgagccgaagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggccagcagaaaactgagcttccggtcacagagaacgtgcagacgattcccccgccatatgtggtccgcaccatccttgtctacagccgtccaccttgccagccccagttctccttgacggagcccatgaaggtgggtgaggcctgggagagggaggggtgcctgcagccatga

SEQ ID NO: 3470 - DNA, 3549 bp, Homo sapiens
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtggtgagtatagacctggcccatgggggcagctgcaccgtgggcgtggtgagcgaggatgtgcagcggaagggggagcttcggctgcggccagaggagggggtgtgggctgtgaggctggcttggggcttcgtctcggctctgggctccttccccacacggctgaccctgaaggagcagccccggcaggtgagggtgtctcttgactatgaggtgggctgggtgaccttcaccaacgctgtcacccgagagcccatctacaccttcactgcctccttcactaggaaggtcattcccttctttgggctctggggccgagggtccagtttctccctgagctcctgagaaggagcagttacctactctcctctaagtacaggactcatatcaacccaagtaccatgtggacttgatccctggctgaatcacctggatgacttggaatagaaatgactgctttagaagatgggatggggccgggtggtgagggatagaagagaggactctcaatctactgatcaagtcctttccccaatgcccagtggatggccagggtacctggggactcaggctgctgccagttctgctcaccaccatccgtgcttggcacagaagtagctgcatagaaagagcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatgtagagaaaaaaaaaacctgctctatatctgaaagagctcttgggaagacagagaaacataaagaggaaattatagcacagtgtggtgggtgttacgggaagtccaaccccagcattatgggagttcaggggaaggggcatagcccagcctggaaggagaggatgagtgggggatggctttctgaaaagggtagtctaaaggatgcctatagtcaatagggaaaagaggggaagaagcatcttaagaagaggaaacagcagagaactggctggatgacctgtgactctggagcactgggttgtctccattgtccttatgggcagatgtgtgccatccccagccgacaccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgacctttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagatgtaaaatacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattaaagattgaattgctttccctgggagtgtgcagtatctcattaaaatgttgtatattcaaaaaaatacagacacacacaagtgcctatataatgataaaacatatgcaaagcacccaaacctgtgattccagaaaggtagatcctatttttctgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 3471 - DNA, 4356 bp, Homo sapiens
aagcagataggtttcagagataaagagtgaaaccaaaaacaccgcacacctcatccaaatctgcgctcatacttgcagcaaatgtttgctgtcagttgcttcataataacagcacagaccccgaattgcaggaggaattgcctggtagaaaactgaagactttaataacaaactctccaaggtgaaaatgaacacagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccacctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatggttcacagtgcctgaattacacctgctccgaaaactagctttgtatttcttatgactttgcataagaactgttcatctttggatcttgagcaccttacagataaaactttttatggcatctctttcatggacagtgatattgatcttttcacaatgtacgtagcctctagaattttgtacatatgtttgctctttttttgtacagactagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtatacttcagtttttcttcttgacatttatctttataaaaattgtgtattttattccaacttgttaaactaagagaaaatgca

SEQ ID NO: 3472 - DNA, 1456 bp, Homo sapiens; identical to SEQ ID NO: 1946

SEQ ID NO: 3473 - DNA, 2607 bp, Homo sapiens
gcctgaactgtttgtacctctgggccatattgcagaaccctgcccttctttgttgactgaggaaagctcgctccctgcccaggtttttcattgttgatcgaaattaacaccaggtggtgaatagagcccctcctaaggttgctcaggataaatcatttattaaataggtctgcttatcaggaggggcgtgaaggctcccaaaaggaaatgctggcacctgggcccagaagccagggcctctaactcctggggttgatttcttcagtgaagttgcaccctacaaagggaatatggccaaagcggcactcaactgaaggctgatatcaggcgattagacagccatgcattctgcgtttgtctggaatggattgtagagagatggacttatatgaggactaccagtccccgtttgattttgatgcaggagtgaacaaaagctatctctacttgtctcctagtggaaattcatctccacccggatcacctactcttcagaaatttggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaatatacgttccattcagcattcaattagcatgcctgctatgagaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtag

SEQ ID NO: 3474 - DNA, 572 bp, Homo sapiens
ttttcggaggctgccagcgtcccacaccagccgcaggtgaaaaccggcagaaagacattaagagattttcctgcagtcactgctggcagatgatagagccaggatttgaaagcaggcagcctggctccagaccctgtgctcttaactcccgttttgcatcaagaacagaatcctatgaaaggcttgcacagtgcttggtactgagtaggcactccgtcagtattttagtagctattattccaaaggacactgtattctaggatagcagcatcaaggagcattgtgtacatgcagaagtgcacagtacctggagtgaaactgcttgtgttcgatttctgataccattcataactggctgtgtgatctcaaataagaaaactgaagaaccagctgggcgcggtagctcacgcctgtaatcccagcactttgggaggctgaggcgggtggattacctgagaacctctaaaatgcagacctccagctctagatctgtgcacctgagtgaatggcagaagaattacttcgcaattacatctggcatatgtaccggaccgaaggcagatgcataccgt

SEQ ID NO: 3475 - DNA, 2792 bp, Homo sapiens
aggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagtgctattacttcatcccggaatttcctttacccagcctatgtctactttccctcctctgtcccctccccacccagaaagtacacacaaacctattatgcagctgtgcccgcgggctggtgggggagtggaggtggaccagcaacacagcctgcagcaggtggaaggtggcggttcctgcacatactcggtacacagccccagagccactgagcactggacagtcagagaggccaaacaggaggcagcagattgctgaggcccccacatggaggaggatgtagaacaggcggctgcaagtggatgcggtgagagagggccacctagagtggcagcagctggcacaaggagcaggcccacagcagcacacctgggagtagagcagatgcaaggcagcgaggtggagacttgctgaggaaaggcatacgttaatgtatgtgtgaggttaacccaggaggttgaattccaaaatttccccttcccctttcttccttttactcaggttctgtttcaagctgattccagccatttgggattgccgcccactgacaacttagtagggctttcattataagcaggcttgagatatctgacctttctctcgacctaaacacctggggctggaaacatggcgggagagatttacagattatacctggggcaacgaaccagaacgacattagaggagaaaagaggcctgtcgtttttattggcttctgcacgtcttcctccccagcttcggccactctccccttcgcaccctctcacctgacagaagggacttttcactaggacactgctgcctccgctgtgctgctgtgccaggcccagggaggtgccggggctggggccggccttggcacccaccatccttgtcccagggattaggcttaggtccaccagatggaaggcagatgagagcagcagttgcttctgtcctcagcccattggactgccactgtgttggggctgagcacccggtcccgggcagaatggagacgtccggaagagaacactgacctccaggttgcggtaaatgcaaatgccctgtgaaggagctttgtccttagggcctcaacactgcggccactcaggctgttctctccagattagggggcagtttgtctatctggccccctgtggattagcattctttattggtttaggattagacgtcattcaggttgaacggagttccctgaggtgggtgggtgcgtgtttatgtgttgaggggactattcctagtttatgaggtggttaaggatatcggtggggtgggctggagcggtgtcgggttaggtctgagagaaggcctcgcacaaaacactgtacaaacccgaaaggaagtctgagagacgaaccgccttcctccctgaagcttctagaactggagcagaaagaaggtgtggcccagggccagccccgcctcctccccgggcggaagctgtgtcagttgccggaagtcggcgtgaggtggggcttatgcggcggcgtggtgaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaataatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttcagttttatcatcttgggtcaagtagagtgtatactatatcctatgttgtggagaatttatatgttggagactaactgaatttaagtgacccattaaaatctagcacacctgtatgaaaaatcagtgtagaagaatacctcatgtgcagatgctaggtggcaggccagtctcattcatctgactagctctcaacagtattcaaggtacatctggagtctcagcagagttactgtactcaaatggcatgtgtctccaagacagcttatgaatatctaaaaggccagctacctgcctaggagccactatatatatagatagatgtaggttatgaacccagttcataggccaccttgagttagaattttggtacctacaacatgcttgattttgagtgattaaaaaaaaataatttggctgggtgctgtggctcacacctctaatcccagcactttgggaggtcgaggcaggtagatcacgaggtcaggaattcaagaccagcctggccaacatgtgaaaccccgtctccactgaaaatagaaaaattagctgggcatggtggtgggcgcctataatcccagctattctggaggctgaggcaggaatcgcttgaaattggaaagcagaggttgcagtgagctgagatcacactactgtactactgtactccagcctgggggaaagagtgaaactccatctcaaaaaaaaaaaaaaaaaaaa

SEQ ID NO: 3476 - DNA, 3198 bp, Homo sapiens
agtaacgccttctccaagtggatggcggggtggacacgcgtcccggcgccccgggctccctgggatatgtagttcgcgacaggacgagcggaaatactgccaggattttaccacctctcgcccatttatttacttctcggtcaccgctttcgggggacagataaacaccacagatgcccatcaaaggggcgcacgggtctggaggcgcagctcaggtttttgcgttggtcaccctgccctccgcacgtggagagggcaggcataaagcaccttgaaaggaaggtgctgtcaatgctatccgacgacctgtcgccgggcaccgcagcatcctcgctcgctccgatgggacgagggacgccggccccagggtaacaggaggcgcctcgccggccgcgcgctggatgctgtgatccaggtccggagccgggttccgccgcggccgcagcgacccgaccccacccgacaggccagaggcaatgcaaagaaacaagtttccaagagaaaaacttcagataaaaagggaagatatcagaaggaatgtcctcagcattctcctcttgaagatattaaacagcggaaagtattagacctcagacgatggtactgcataagccgaccacagtataagacttcttgtggcatctcttcattaatttcttgttggaatttcttatacagcacaatgggagctggaaaccttccacctattacccaagaagaagctttacatattctgggctttcaacctccatttgaagatattaggtttggtcctttcacggggaatacaacacttatgaggtggtttagacaaattaatgaccacttccatgtaaaaggatgctcttatgttctatataagcctcatgggaagaataaaacagcaggagaaactgcttcaggggccctgtcaaagttaacccgtggattgaaagatgaatcgctggcttatatctatcattgccaaaatcattatttttgtccaattggcttcgaagcaacccctgttaaagctaataaagcattcagcaggggacctctctcaccacaggaagttgaatattggatcttaattggagaatcaagtagaaaacatcctgccattcactgtaaaaaatgggcagatattgttactgatctaaacactcaaaatccagaatacctggatatccggcacttagagaggggactgcagtatagaaaaacaaagaagccaacatttttttcttctcaggttgggggaaatttgcattgcatcatagcattccagagacttaactggcaaagatttggcctttggaactttccatttggaaccattagacaagaatcacaacctccaacacatgcccagggaattgccaaatctgagagtgaagacaatatttccaagaagcagcatgggcgtctgggccggtctttcagtgctagtttccatcaggactcggcatggaaaaagatgtctagtatccatgagagaaggaacagtggttaccagggttacagtgattacgatgggaatgattgactatgcttgctactgaacagctggcattatatatgaaactgctatatacaggactgtataaagacagtagaagattttagtaagcctacattaaataggagcagatcttgtggtataaaaaataaccttgtagttctccagatactaagcttgtatatgattatggtgggtgatttcagatatataagcagataagcacagattattgtcctttcaagttaagagtatataatctggacagaaaatttcacaaaattcaataaaattacaactgttgtctaaataagtgaaacacaaattcacttaatagcatcaagatttgaaatacttaagcatgaagtgacttttataatgactcgatccctagacatttgttacagatagttttatgcctaagaccaagatgtaaagtaccatctgcccttaaaaaaaattggggctgtcaatttctagttttcactcatggttaacacgcatttaaaattatttcatgagtctagtagttctttgatttatagcaggatcttgcttgcctcatttgtttcctggttatgttcttaggattctgactaagaggcaaaagagaaaagactcaagaaactgatcctggagatcgagaccatcctggctaacatggtgaaaccccgtctctactaaacatacaaaaaattagccgggtgtagtggtgggcacctgtagtcctagctactcgagaggctgaggcaggagaatggcgtgaacccgggaggtggagcttgcagtgagcggagatcgcgccactgcactccagcctgggcgacagggcaagactctgtctcaaaaaaaaaaaaaaaaaaaaagacggatccttttttttggtgcaaatgggtgacttagtgcattgattcagatttttaaaatttcttgatgtggtttgtaataatcaaatattgacaagaaccttaggtctcgaaagacttttataagtctagatgacgtttgccttaggggtaaagtaaaagaacaattggcaccttaagtttctatacccaaggttatctgtgaaatgagatctcctgatatttgattgctttctcagtatggagtcatatgttgataacagtactgaagatgcataagaaatgcccaagtcactcagaggacaactacccatattccagactctgagctgtttcctttttaaaaatcatatagacaattagctgtttgaagtgagtattaaatatttcagaagtgtgaatttcatgtatttgagctcctctagttgctgttggtttttcttctgctgccaacctgtgactcacaaatgactaggatctcttgttctttaattttagggtcttgttccaggactcaaatcagtaacttggtgattacaaggtgctgaatgtgttggtaaccatatcgcaatacacctcaaggaaaaggttcagatttttatttttaaaatattttcatttttttcttgaattttatatccgtttgttcactcgtacatgcctagcctacagaaggggatatatattatgaaatggtcatttttctgaagagaatattttgcttgaaatgcaaaggactgaaagagatttgtaggttgttgattttgttacttcatactggaacttttaaaaagatttcatcaaataaagttttgttttctacttttaatt

SEQ ID NO: 3477 - DNA, 486 bp, Homo sapiens
ggacaacgccctggcgagggcgaggtggggtgtgcgccgcgcctgagaggcgggtccctgcctcgccgcaggtgacgggctcccctccccaggtgtgtgggcgcagccggccgccgccgacctcttcggccccctgagaggtgccctctcctcccgagctccctcccccacgaagagtcgggtgcagggctgggccccgcggtgacaggcgcggtgtctacgaagaccgtgtggctggaagatcggccttgctggtatgatttaagcttggatgaaatgagagctttgacagttcagagagtgaagtttgccatggacctgcctctgttaaaacgtgcaggtcaggatctggcagagaaaacaaagaattttgtcagccgaagccttgtcataggagaagtcctctccatggcggacatggccacaggagtgaagtgcggaataatttattggctatttggtggtgctatcaggaatctcggaagc

SEQ ID NO: 3478 - DNA, 3936 bp, Homo sapiens
acaccctcgcggagagagcggttcttgcagcatcctgcgcagcccctgcccagtttggtgcagaggcgtggggggcgggacgcgtctttgccattctgatagcggggaaagcggtgagaatcgaagtgaggagccgccagaggagagctgaggagaggagggggaggtcgacgacctgggccctgggcctctgaaggtccatctccactggtggctgtggtggctttggattgttggaagaccatcaccttcagcaggtctgcacttgggaacaatcattctcccccagcccgagcgtgcctctgccctctgtatcattgacagaggctgtatgtttggaaagagaactttgtgactgcagaactgacagttgactctaattcttgctaccaagtttttccccgacccagtgaaagagtgttaagacttcgacctaggacacattgagaaccaaggccaagactggacagggccatataactgggcttcaaccatggctgggactaagaataagacaagagcccaggccaaaactgaaaaaaaggctgctatacaagctaaagctggagcagagagggaggctactggtgttgttaggcctgtagccaagaccagggccaaagcaaaagccaagacagggtctaagacagatgcagtagcagagatgaaggcagtgtctaagaacaaggttgttgctgagacgaaggaaggagctctgtcagagcctaagactctgggcaaagccatgggagatttcactcccaaggctgggaatgagtccaccagctccacatgtaaaaatgaggctggtactgatgcctggttctgggctggggaagaggccactatcaattcctggttctggaatggagaagaggctggtaatagtttcagcactaagaatgataaacctgaaattggtgcccaggtctgtgctgaggagttggaacctgcggctggggccgattgcaaacctaggtcaggggctgaggaggaggaggaagagaatgttattgggaactggttttgggaaggagatgatactagttttgaccctaatcctaaacctgtgagcaggatagttaagcctcagcctgtgtatgaaattaatgaaaaaaataggcccaaggactggtctgaggtaactatctggcccaatgcccctgctgtaactccagctgtgttaggatttagatcccaggcaccatctgaggcaagccctccttcatatattgttctggcctccgctgaagaaaatgcctgttctttgcctgtggcaacagcttgccgcccttctaggaacactcgctcatgctcacagcctatccctgagtgtcgttttgattctgacccctgcatccagaccatagatgagattagacgtcaaatcaggatcagggaggtaaatgggattaagccatttgcttgtccttgcaaaatggaatgctatatggattctgaggaatttgaaaaacttgttagcttacttaagtcaactactgatcctcttattcataaaatagcacggattgcaatgggtgtccataatgttcacccatttgcccaagagtttattaacgaagtaggtgtagtgacacttattgaaagcttgctcagttttccttcccctgaaatgagaaaaaagactgtaattactctgaatcctccttctggggatgaaagacaacgcaaaattgaattacatgttaagcatatgtgtaaagaaaccatgtcatttcctttgaactcaccgggacagcaatctggattaaagatactaggacaactgactactgattttgtccatcactacattgttgccaattacttttcagagcttttccatttgctgtcctcaggaaattgcaaaaccagaaatcttgttttgaaactacttttaaatatgtctgaaaatccaactgcagccagagacatgatcaatatgaaggcattggcagcattaaaactcatctttaaccagaaagaggcaaaagccaatcttgttagtggtgtggccatatttattaacataaaggagcatatcagaaaaggctcaattgtagttgttgatcacttgagttataatacactcatggccattttcagggaagttaaagagattattgaaacaatgtaaaatgagccagagatagaacattttaagccatcttcaaactctagcaggctgtacattacagtgtacacattatacactgcatctttaacacagagtcacctgtgacaggctctaggtttgagctagactattttgggggtatcaaatgaatattataccttgggctgaaaatgtttgatttttatcttgtctagattggcatatttttaacattttacttaagatagcaaaccagttcgttttaagtaagctaacttgttcattagtatctgtggcttaaaatggcaaaaaagaaaatatccttgagtttgtaatctagttacagaagtaaggcatacacacacacaaagataacagtacctagagagagagtgtgtgtgagtgtgcgtgtctctgtgtgtgcacgtgcacgctcatggccaaatgtgcgcactctacataaaggaggcaggagttcctataggctatttaatgtaagagaaactatttttctcctgttccagctgtatcagatactcgttccgcaacacagaaatgactcagaatctcagacaaaatgtattatttgttcaattttaattttgctactacattcataactcttaaattgttaggctgtttcatttacatcaaagttatctcacaaaagagaaggcaggaaacgttttgtgagtgcctattctatgtcaaacactgtgttggcaccatattttacaagtttttttcctcttctcacagtgatcttgtgagttagttacttatatttttattagaactcattattctgggtaccctccaatgagaattagagaggttaaataccttttcctagattcccacagcaggaaggtggcatagctgttttgtctgacaccagaacccatctcaccacactgctttacagtcttcctgaaggacattttgaggtgggggggccttcaaagctcagagactggtttgaatggtttaattttgcaatggatcatgtccatgccaggtgttacaattcttaacttcctccaaattcgtgtgtccattagacatttggctacatctggctggaggtcaggagaaaattctgaggtaaatagatggattttatctggcagtgtcgaaaatagtaggagcctaaaactttgttcaatgagtaagatgtagatttggagtcatcagcaggggaaacttgttagatgtcctttgtatctttttctatccatttgtattttttctttcccaaagagctgaaatcattttataccctgaatttaaaaggtaattgcttttttcctccttgcgaaatcataccttaattttttttttttttttttttaccatttatgatttattctcctatgtgtcatatgaaaggccaaggggctttatcttttactagtaggcaagcctgggcatttctgcatttgtgccagctaacactacaaaatagacttaattagagaaatttagacccagaattgcagcttcaacaacacaaaacaggaaagctagaagaggttgctgtgtcaacctacaagatagtgattcttggaagttggtatggaccagaaagcattcccaggacatttaggctatggctgagttctctaagactcagggtgggaattataatccctggtctaagctgatatgaaagtttctatgtgtgaaaatatggagttatatgctttgagattttctgccagttaaactaaaacaagatcatactgtaaatgtttgtaacttgcttccccccactgtatactgtaaacatctttgcatgtcaataaatatgcctctacaac

SEQ ID NO: 3479 - DNA, 489 bp, Homo sapiens
atgtcctacaactgttgctctagaaacttctcctcctgctcccacgggggttacttgcactacccaggctcctcctgtggctcttcctaccccagcaacctggtctacagcactgacctctgctctcccagcacctgccagctgggttcctctctctataggggctgtcaggagacctgctggaggcccaacagctgtcagacattctgctactaccccaggactcacatgctctgcaattcttgcctgactatgcatgttgggtctcggggttttggatccaatagctgctgctccctgagctgtggatccaggagctgctcctcactgggctgtggatccaatggcttcagatatctgaattatagaatccatacctccccttcccagagttatagatccagattctgccatccaatctattttccacctagaaggtggttccattcatcttgttatcagccattctgtagatctggtttctactga

SEQ ID NO: 3480 - DNA, 508 bp, Homo sapiens
tatgttttacagtctccatgttcatctccttttatgactttaaaaatatacctcaagatagtagatgtgatggtcaattatttataaatggcaggaataataaaaataattctatttccctgtattttcaaggtggccttagacatgcatctgccagcattgggggttcagaagcctataggcacatgaaatttgaaggaggtgttcacagagtacaaagagtgccaaagacagaaaagcaaggccgcgtccatactagcaccatgactgtagcaatattaccccagcctactgagattaatctggtgattaatccgaaagatttgagaattgacactaagcgagccagtggagctggggggcagcatgtaaataccacggacagtgctgtccggatagttcatcttccaacaggtgttgtttctgaatgtcaacaagagagatctcagctgaaaaataaagagctggctatgacaaagttacgtgcaaaactgtacagcatgcatct

SEQ ID NO: 3481 - DNA, 2166 bp, Homo sapiens
atggaggaagagctgaagtgtcccgtgtgcggctctctgtttcgggagcctatcatcctgccctgttcccacaatgtctgcctgccttgcgctcgcaccatcgcggtgcagaccccggacggcgggagtgcagctggcggcctcggcggcggtgcgggaggtggcggagaccacgcggacaagctcagcttgtacagcgagacagacagcggctacgggtcctacaccccgagcctcaagtcccccaacggggttcgcgtgctgcccatggtgcccgcaccacccggctcctcggctgcggcggctcggggtgccgcctgctcctcgctgtcctcgtcttcgagctccatcacgtgcccgcagtgccaccgcagcgcatccctggaccaccgcggcctgcgcggcttccagcgcaaccggctgctcgaggccatcgtgcagcggtaccagcagggccgcggggccgtgccggggacgtctgcagccgcggcggtggccatctgccagctgtgcgaccgcaccccgccagagccagcagccacgctctgcgagcagtgcgacgtcctctactgctctgcctgccagctcaagtgccatccatcccggggacccttcgccaagcatcgcctgggcgcccccagcggaggcggcggctgcaagagcccgggaggcgcgggggcgggggcgactgggggcagcacggcccgcaagttccccacgtgtcccgagcatgaaatggagaactacagcatgtactgcgtgagctgtcgaaccccggtgtgttatctgtgcctggaggagggccggcacgccaagcacgaggtgaagccgctgggggccatgtggaagcagcacaaggcacaactatctcaggccttaaatggagtttcagataaggcaaaggaagcaaaggagtttctggttcagctaaagaacatattgcagcagatccaggaaaacggactggactacgaagcctgcctcgttgctcagtgtgatgcccttgtggatgctttaactcgtcagaaagccaagctgctcaccaaggtgactaaagagagggaacacaagttgaagatggtttgggaccagatcaatcactgcacattgaagctgcgtcagtccaccggactgatggagtactgcctggaggtgatcaaggagaacgacccctccgggttcttacagatctcagatgctctgatcaagcgcgtccaggtgtctcaggagcagtgggtcaaaggcgccctggagccgaaagtgtctgcggagtttgatctgactttggacagcgagccgctgctgcaggccatccaccagctggacttcattcagatgaaatgtagggtgccacccgtccccctactgcagctggagaaatgctgcacccgtaacaacagcgtcacgctggcctggaggatgccacccttcacccacagccccgtggacggctacatcctggagctggacgacggtgccgggggacagttccgggaagtgtacgtcggtaaggagactttgtgtaccatcgacggtcttcacttcaacagcacctacaacgcccgagtcaaagctttcaactcttctggtgtcgggccttacagtaaaactgtcgtcctgcagacatccgatgtggcctggttcacatttgaccccaactctgggcatcgggacatcattttatccaatgacaaccagacagccacctgcagcagctatgacgaccgggtggtgctgggcacagctgcgttctccaagggcgtgcactactgggagctgcacgtggaccggtacgacaaccacccagaccccgccttcggggtggccagggccagcgtggtcaaggacatgatgctgggcaaggatgacaaggcctgggccatgtatgtggacaacaaccgcagctggttcatgcactgcaactcccacaccaacaggacggaaggtggcgtgtgcaagggggccaccgtgggcgtgctgctggacctgaataagcacactctcaccttcttcatcaacgggcagcagcagggccccacagccttcagccacgtggacggggtcttcatgccagccctcagcctcaaccgcaacgtgcaggtcaccctgcacacaggattggaagtgccgactaacctggggcggccaaagctgtcaggcaattag

SEQ ID NO: 3482 - DNA, 2382 bp, Homo sapiens
ttcgcggtgccaccgccccgcccacgcctcctcgccggcctccgagtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagca

SEQ ID NO: 3483 - DNA, 1041 bp, Homo sapiens
ggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagc

SEQ ID NO: 3484 - DNA, 567 bp, Homo sapiens
aggtcgcgccaggcagggcccccttcgcggcgggcccgcgcgggtcccttccacagcaaggccacgcggtccccctagcctctcccgagtcccagctgcggcgtgggcgcgttcccatcgggactcgtggacgcgtcctgctcccagctgcctttcgtctagagaaaggcaaccagatgtttgaggagggcttggtggacaaaggtgacattcatgctccactatatgcaaaactggccaaaggagaggaaatggaaaaatatcttggctctgacaattggttcagatgcagtaaataaaaggaaaatgaacttaagaaatgcttaatggatgcctaaagcagcttgtgatcactggaagatcaattcttttatcatccatactttagaggcagcaaaatcgaagctttcttcaccagtaaaagggaatgcgaagtaaatcacaacaaaattccatttcaccttcatcacactagaatagccaaacttaaaagtctgaattgggtaaaaataagtgactaaagaagcagacctgggaatcacctaacatgtcgaggaggagatttga

SEQ ID NO: 3485 - DNA, 657 bp, Homo sapiens
tttgttaaaaatcagaaaacctttgacacacttttagataaatacacctactcctttgatcctttgtgtatgtattaccacagggcttaaatatcttaagattttagttaatgtcattttcatgaaagacagtcatttggaagccaagagctctatctatgttttgttcaaatagccgagtaatctactatcttggcagtaattacttctgctgcatttctaatgtgaattgcatgtgagagcttatgaatacactcttttcaagtgtatgtgggttttcaaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaaga

SEQ ID NO: 3486 - DNA, 3546 bp, Homo sapiens; identical to SEQ ID NO: 3030

SEQ ID NO: 3487 - DNA, 469 bp, Homo sapiens; identical to SEQ ID NO: 1740

SEQ ID NO: 3488 - DNA, 3354 bp, Homo sapiens
gcggcggcctgaactcacctaacaccgcagcagcaaccgggcccggccaggttcggcgttccgtgagtgaacgatttagaaatctggactggccagtgacctctgggcttgccattccagcctggtataacctctggctccatgggcagctactggctcctacagaccggatgaagcagactggagacacaagtggagaaaacctccagctggcaaatcctcagagtgtaggcctctggctgccagtcctgcccagcctgcctcatggagaggatgaattggctgagcagactggcctcccggggccctgggcaccgtatacctcaaggggccaatctccaaaccccagtcatggctgatcccgagacctgcctcatggtcttcaagaatcactggtcccaggtggtgcgaatcctggagcggcaaggccctcgggcagctcctgggggtgcagacgatctcagtgctgtgcgcaaccacacttaccagatgttgacactgctggcagaggaccgtgcagttccctcggcccccacaggccctgggcccctgctggagtttgctctgcacgaggatctgctgacccgtgtgttgacatggcagctgcaatgggatgagcttggggatggggtcgaggaacggcgggctgagcaactgaaactatttgaaatgctagtgagcgaagctcgccagccactgttgcggcatggtccagttcgtgaggctctgctcaccctgctggatgcctgtggccgccctgtgcccagtagcccagcactggatgaaggcttggtgctacttctcagccagctgtgtgtttgtgtggcccaggagccttcattgctcgagttcttcctgcagccacctcctgagcctggagccgctccccgtcttcttctcttttctcgccttgtcccttttgtgcatcgagagggcaccctgggccagcaggcccgtgatgccctacttcttctcatggctttgtcagctgggagccccactgtgggccgctacatcgcggatcactcttacttctgcccggtgctggccacagggctcagtgccctgtactcatcactgcctcgaaagattgaggttccaggggatgattggcactgtctgcgacgggaagactggctgggagtgccagcccttgcactcttcatgagttccctggagttctgcaatgcagtaattcaggtggctcaccccctggtgcagaagcagttggttgattatatccataatgggttcctggtgcctgtcatgggtcctgccttgcacaagacctctgtggaggagatgatcgccagtaccgcctatctggaacttttcctacggagtatctcagagcctgctttgctccgtaccttcctgcgattcctgttgttgcaccggcatgacacccacaccatcctcgacaccctcgttgctcgtattggcagtaactcccggctctgcatggtctctctgagtctcttcaggaccctcctgaacctcagctgtgaggatgtcctgctgcagctggttctcaggtatcttgttccatgtaaccacgttatgctgagccagaagccggctgttcgtgatgtggacctatatggacgagcagctgacaagtttctctccctaatcccacgctgttgtcggcaccacgcccccagcccacctcgtccagagcatgcctcatgggcacgaggtcctggaagcccaagtgtggactcctcttctgtgacgacagtaccccggccctccacaccatctcgtctggctctcttcctgcggcagcagagcctgggtggctctgagtctccaggcccagccccttgctcaccagggctttctgcatcccccgcctccagccctggccgacggcctacccctgcagaggagcctggagagctggaagacaattacctggagtatctgcgtgaggcacgtcgtggtgtggaccgctgtgtccgagcctgccgtacctggtctgccccctatgatggcgagcggccctctcctgagcccagtccttttggctcccggactaagaaacgcagcctactgcctgaggaggacaggaacaacgtgggggaaggggaggaggaagagctggggaggagggggcgggctgggggtgcaggggagggccctggtcacctgccccctccccagctcaatggagtgccaggatcatggcctgagggggccaagaaggttcgtctggtgccaaaggagggagctggggaactgctagagggcatctccgagggcatggcaggactagagggctttgggcaggagctccgggagctagaggtggcattgagcaatgggggaactggctcagagtcccccttagaacctccactgccccttgaggaggaggaggcctacgagagcttcacctgtccccctgagccccctggccccttcctcagcagccctttgcggactctcaaccagctgccaagccagcccttcactggccccttcatggctgtgctctttgccaaactcgagaacatgctgcagaactccgtctatgtcaacttcctgctgacggggctggtggcccagctggcctgtcacccccagcccctgctccgctctttcctgctcaacaccaacatggtcttccagcccagtgtcaagtccctgctgcaggtgctgggctctgtgaagaataagattgagaactttgcggcttcccaggaggacttcccagcactgctgtccaaagccaagaagtacctcattgcccgtggcaagttggactgggctgagggccctgcagcaggacctgccccacgccgttctgatcccctagtgaagagccggaggccatccttgggggagttactcctgcggcatgcacacagtccaaccagggcccggcaggcggcacaattggtccttcagcctgggcgagacggagcaggacttggcctaagtgggggctcccctggggcttcaactccagttctactcacccggggcggggcccctgaacgccaaggtgaggctcttcgagtcaagaatgctgtctactgtgcagtcattttccctgaatttctcaaggagttggctgccatctcccaggctcatgccgtcacctcgcctttcttgttggagacttcagaggaaggatctggccctctcatctcaggctgtgggcccctcaatccttaactttcttccatggacaatcagggccatgggtggcccgggctggggctagggcacaggctcctttttatgtttggaggcagtggcaaaaggactttttaatttatttcagatgaatgttttatggagaacttgttgcaatatgtataaaagggaaatctctattctgtgctc

SEQ ID NO: 3489 - DNA, 2179 bp, Homo sapiens
agctttccagttctgctttaggacccgccccccagcacgctcctcgacgctgcgaggtcccgccccgcgtgctggccgcggtaaaagtggtagcagcggaggcgagcggagggtttcccgcggcggatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtcatcttatgcagatatgctacatgacaaagacagagttttcaagcctatggctgatgctgctgtgaagattgtggagaaaaatggctttagtgataagattaaggttatcaacaagcattccaccgaggtgactgtaggtccagagggtgacatgccatgccgtgccaacatcctggtcacagagttgtttgacacagagctgatcggggagggggcgctgccctcctatgagcacgcacacaggcatctcgtggaggaaaattgtgaggccgtgccccacagagccaccgtctatgcacagctggtggagtccgggaggatgtggtcgtggaacaagctatttcccatccacgtgcagaccagcctcggagagcaggtcatcgtccctcccgttgacgtggagagctgccctggcgcaccctctgtctgtgacattcagctgaaccaggtgtcaccagccgactttacagtcctcagcgatgtgctgcccatgttcagcatagacttcagcaagcaagtcagtagctcagcagcctgccatagcaggcggtttgaacctctgacatctggccgagctcaggtggttctctcgtggtgggacattgaaatggaccctgaggggaagatcaagtgcaccatggcccccttctgggcacactcagacccagaggagatgcagtggcgggaccactggatgcagtgtgtgtacttcctgccacaagaggagcctgtggtgcagggctcagcgctctatctggtagcccaccacgatgactactgcgtatggtacagcctgcagaggaccagccctgaaaagaatgagagagtccgccagatgcgccccgtgtgtgactgccaggctcacctgctctggaaccggcctcggtttggagagatcaatgaccaggacagaactgatcgatacgtccaggctctgaggaccgtgctgaagccagacagcgtgtgcctgtgtgtcagcgatggcagcctgctctccgtgctggcccatcacctgggggtggagcaggtgtttacagtcgagagttcagcagcttctcacaaactgttgagaaaaatcttcaaggctaaccacttggaagataaaattaacatcatagagaaacggccggaattattaacaaatgaggacctacagggcagaaaggtctctctcctcctgggcgagccgttcttcactaccagcctgctgccgtggcacaacctctacttctggtacgtgcggaccgctgtggaccagcacctggggccaggtgccatggtgatgccccaggcagcctcgctgcacgctgtggttgtggagttcagggacctgtggcggatccggagcccctgtggtgactgcgaaggcttcgacgtgcacatcatggacgacatgattaagcgtgccctggacttcagggagagcagggaagctgagccccacccgctgtgggagtacccatgccgcagcctctccgagccctggcagatcctgacctttgacttccagcagccggtgcccctgcagcccctgtgtgccgagggcaccgtggagctcagaaggcccgggcagagccacgcagcggtgctatggatggagtaccacctgaccccggagtgcacgctcagcactggcctcctggagcctgcagaccccgaggggggctgctgctggaacccccactgcaagcaggccgtctacttcttcagccctgccccagatcccagagcactgctgggtggcccacggactgtcagctatgcagtggagtttcaccccgacacaggcgacatcatcatggagttcaggcatgcagataccccagactgaccactcttgagcaataaagtggcctgagggctggggttctg

SEQ ID NO: 3490 - DNA, 3049 bp, Homo sapiens
gagctgagaggaccagccattttacttatggaaaacagtgtggcatattctgctgagcttcgccctggaagaagcctcttttatacatctcttcagggaagagagaagcaatgggcatgttagtatacaatgatcacagccacgcaggcctgcaagctgccttttggacaggctgttgactgccgttccaattagctgattggagaatgtggaatgcagagtgataatgctgcatatctgctatcaggcagcagcaaaggtttttgtcttgggaaggcaagctttccctgcaatattatctcagcagctccctagctgcttaccctgaaaacgagggatccaaacggagggtgttgcactctgctaacgctggtcctgtgcgtggctgtggcatatgagcggcaggtctgaaaaagcaggtgtgtgctgggacgggcactggactggaacgcaggcggacgctctcgggtttacctgcttcctgttaacagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccgggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaa

SEQ ID NO: 3491 - DNA, 2372 bp, Homo sapiens
ggcaggcggcgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaagaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatc

SEQ ID NO: 3492 - DNA, 1047 bp, Homo sapiens
gaccgtgacgtagaaggtggagaccgcttcaccctgatcagggagtatcggctgcgggtgcgcaaggcgtccaggagtgacctggggctgtggagagcgacccgtggccttgtgtttcagaaaaaggaccagtgatgtctaagactcatgatcatcaattggaatcaagtctcagtcctgtggaagtgtttgctaaaacatctgcctccctggagatgaatcaaggcgtttcagaggaaagaattcaccttggctctagccctaaaaaagggggaaattgtgatctcagccaccaggaaagacttcagtcgaagtcccttcatttgtctcctcaagaacaatctgccagttatcaagacaggaggcaatcctggcggcgagcaagtatgaaagaaacgaaccggcggaagtcgctgcatcccattcaccagggcatcacagagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcg

SEQ ID NO: 3493 - DNA, 2853 bp, Homo sapiens; identical to SEQ ID NO: 2528

SEQ ID NO: 3494 - DNA, 3050 bp, Homo sapiens
gtgcgccgtggcgccgcctgcgaccggcagctcgttcgccgcactttggaggcttcggctgcccctccgacccacgtagggcccggacccgggcctccttgtgaacagcgtgccggcttcgccccacgggttcaccggctggctgggcttcaagcgccgaggccgccgcagtgaccccgcccccgggccgaggatgtgaggcgggccgggcgtccccacaccgggcccgggcgccgggagtgggcgtctgggcagcgccaggcgatggccctgctgctggtgctcctcgcctcttggggcctggggcagtgagggggccggcgggcgtgggccgagtggccgcgggcgccatggagggggtgctgtacaagtggaccaactatctgagcggttggcagcctcgatggttccttctctgtgggggaatattgtcctattatgattctcctgaagatgcctggaaaggttgcaaagggagcatacaaatggcagtctgtgaaattcaagttcattctgtagataatacacgcatggacctgataatccctggggaacagtatttctacctgaaggccagaagtgtggctgaaagacagcggtggctggtggccctgggatcagccaaggcttgcctgactgacagtaggacccagaaggagaaagagtttgctgaaaacactgaaaacttgaaaaccaaaatgtcagaactaagactctactgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagatcgcaaatgcagccttcacctctgagctgctctaccgcactccaccaggatcacctcagctggccatgctcaagtccagcaagatgaaacatcctattataccaattcataattcattggaaaggcaaatggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataacagtccaaggtgaaataaggaaggaagatggaatggaaaacctgaaaaatcatgacaataacttgactcagtctggatcagactcaagttgctctccggaatgcctctgggaggaaggcaaagaagttatcccaactttctttagtaccatgaacacaagctttagtgacattgaacttctggaagacagtggcattcccacagaagcattcttggcatcatgttatgctgtggttccagtattagacaaacttggccctacagtgtttgctcctgttaagatggatcttgttggaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggagaaggatatccagacagccctaaataatgcatatggtaaaacattgcggcaacaccatggctgggtagttcgaggggtttttgcgttagctttaagggcagctccatcctatgaagattttgtggccgcgttaaccgtaaaggaaggtgaccaccagaaagaagctttcagtattgggatgcagagggacctcagcctttacctccctgccatggagaagcagctggccatactggacactttatatgaggtccacgggctggaatctgatgaggtggtatgatggctgctgggcagcacctcctaacttcagggaataagtgctaaagtgttttgttgccctacttaatttccagcaacagcctcaaccctctccaaccccttcacctggggggatggacaggaggtggcaaaacccagtgcttttataatttttaaaatgcatatgtgttttgtttaaagatcaaggtgctatatatttcagttcagcaggcctactggaaaccaaatgataagctgctgtagacttgaacagcaagttataagagcagatttaacaaacaaatttgctgttattgtgtattgtattgtttttatattttagtctaatgggccacccaaacccaagctgaaaatcagcaaattccatattaagtaccataattcatagccagtgtttcagccaacttagactagacatttggaggtagtataagctgctttgttgaagctgtgtagagtttgctgttcctagatgttcttcagtggaccctcttcactgcaactctgtcagtgataagggcctgtgtagtaaagatgttcagggcattcacatgaccatgcaattgtgggaggcgaagaagacgtggacaggagtcccatccttgctgacaggcatgaaaccgttgctctgagaagattaatggtgtgccctagccccaagttggaggggagaatatgagagaggtgggacaggtcatttgagatgacacctcccaactgcctaccatttaccagcatgttccccatgcattatctcaattggacatcacaagtaatgatacccagagggattattactccacttcaaaagcaaggtttagaagttgagggatctgttcacagtcacatagtttttaagcagaggagccagataatttccaagtgtgacctggactgcctctgcatcaaagtcatatggagtgcttgttcaaacagcagattcccaggccttattttggcctaaagaaccagagtctaggtggtgggacataggaatctgcatttcagtaaactttacacgtgattcttctgcacacagtattgaagagcaactagattaaattctagtttacaaaattaccagttttcttcaagaactaaatgatatgtcctttttttttttttcaaagaggataaggct

SEQ ID NO: 3495 - DNA, 3546 bp, Homo sapiens
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccaacgttttgaccgggccacctgtgttctggcccacactggcatcacaggggggagacacacgtgggtggtgagtatagacctggcccatgggggcagctgcaccgtgggcgtggtgagcgaggatgtgcagcggaagggggagcttcggctgcggccagaggagggggtgtgggctgtgaggctggcttggggcttcgtctcggctctgggctccttccccacacggctgaccctgaaggagcagccccggcaggtgagggtgtctcttgactatgaggtgggctgggtgaccttcaccaacgctgtcacccgagagcccatctacaccttcactgcctccttcactaggaaggtcattcccttctttgggctctggggccgagggtccagtttctccctgagctcctgagaaggagcagttacctactctcctctaagtacaggactcatatcaacccaagtaccatgtggacttgatccctggctgaatcacctggatgacttggaatagaaatgactgctttagaagatgggatggggccgggtggtaagggatagaagagaggactctcaatctactgatcaagtcctttccccaatgcccagtggatggccagggtacctggggactcaggctgctgccagttctgctcaccaccatccgtgcttggcacagaagtagctgcatagaaagggcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagtgtaaactacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattagagattgaattgctttccctgggagtgtgcagtatctcattaaaatgttgtatattcaaaaaaatacagacacacacaagtgcctatataatgataaaacatatccaaagcacccaaacctgtgattccagaaaagtagatcctatttttgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 3496 - DNA, 3271 bp, Homo sapiens
tcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaa

SEQ ID NO: 3497 - DNA, 1935 bp, Homo sapiens
ctgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcagtctccctttagttcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctc

SEQ ID NO: 3498 - DNA, 2200 bp, Homo sapiens
gatggaccccggcgacgccgccattttggagtcttccctaaggatcctctaccggcttttcgagtcagtgctgccgccgctgcccgcggctttgcagagcaggatgaatgtgatagaccacgtgcgggacatggcggccgcggggctgcactccaacgtgcggctcctcagcagcttgttacttacaatgagtaataacaaccctgagttattctccccacctcagaagtaccagcttttggtgtatcatgcagattctctctttcatgataaggaatatcggaatgctgtgagtaagtataccatggctttacagcagaagaaagcgctaagtaaaacttcaaaagtgagaccttcaactggaaattctgcatctactccacaaagtcagtgtcttccatctgaaattgaagtgaaatacaaaatggctgaatgttatacaatgctaaaacaagataaagatgccattgctatacttgatgggatcccttcaagacaaagaactcccaaaataaacatgatgctggcaaacctgtacaagaaggctggtcaggagcgcccttcagtcaccagctataaggaggtgctgaggcagtgcccattagcccttgatgccattctaggcttgttgtccctttctgtaaaaggggcagaggtggcatccatgacaatgaatgtgatccaaaccgtgcctaacttggactggctctctgtgtggatcaaagcgtatgcttttgtgcacactggtgacaactcaagagcaatcagtaccatctgttcactagagaaaaaatccttattgcgagataacgtggacctattgggaagcttggcagatctgtacttcagagctggagacaataaaaactctgtcctcaagtttgaacaggcacagatgttggatccttatctgataaaaggaatggatgtatatggctacctactggcacgagaagggcggctagaggatgttgagaaccttggatgccgccttttcaatatctctgatcagcatgcagaaccgtgggtggtttctggctgtcacagcttctatagcaaacgctactcccgggccctctatttaggagccaaggccattcagctgaacagtaatagtgttcaagctctgctacttaagggagcagcacttaggaacatgggcagagtccaagaagcaataatccactttcgggaggccatacggctcgcaccttgtcgcttagattgttatgaaggtcttatcgaatgttacttagcctccaacagtattcgagaagcaatggtaatggctaacaacgtttacaaaactctgggagcaaatgcacagacccttacccttttagccaccgtttgtcttgaagacccagtgacacaggagaaagccaaaacattattagataaagccctgacccaaaggccagattacattaaggctgtggtgaaaaaagcagaactacttagcagagaacagaaatatgaagatggaattgctttgctgaggaacgcactggctaatcagagtgactgtgtcctgcatcggatcctaggagatttccttgtagctgtcaatgagtatcaggaggcaatggaccagtatagtatagcactaaggtaggcactagcctcccttgggggaaggccactgaggagggtagaggaggcagtgagctgtgtcacaggagttatggaaacacacacacactttgtgtccatggttgaaagcagaataataatagtaatggtagaagagttatttgtgaattcatgacttctaaaaattttttcttaaaatatattaacaacattagagaactgtttcactcataaccatcccacaccactataacatctgtgttcatttgtatagctcatcttctgtccttgcccacacacacatatttttatagggctgtacctagtatatattttatattcttctttttcaaatcaaagtattgtaagtactttcccatgtttctatctactgtagtcattaagaacttgaggtctgaagttttgaatactaccttcaccacctgtgatcttgggcaagttactaacacatttccttgtctatatctagctaccttattagatattaaatgatcgaatgagggttaaatgattatttcatgtaaagctcttagccctgtgcctggtacatagtaaatgctaaataaatagtggtattcttactgtt

SEQ ID NO: 3499 - DNA, 649 bp, Homo sapiens
aagagggataattcctcccaagatcaatttagcaaaatagcggcactgtcgggatcacacattcaggtcctgaatgtgaggctgccagcagtttcattaacctaatcccaggctccttcctcccgcacctgagggttgctcaggcctccctcaaactagccaatgagaagtgcacgggtcctggtcgcctaggaaaccgcgtgacaacaagatggcggcgctgcgggacggctagcggccctgcgtggaggcgaggaatccgcatctatggagatgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggtagagcagggcg

SEQ ID NO: 3500 - DNA, 553 bp, Homo sapiens
agaaggagcagccccccacctggctaccgcagccctctctggttctgtgcagggtattgggatgcgttactgaggcccaaatctgccccactgggaacccccaaaaaagagccagggcaggagaatgagagggaggagccatgaaacccccgccctttaaagacagctctgtggcagctggcccaggccctgcagccctcaccacgttgggactcacttgggggtctcccatgggggtcctaatcccatctcttttcttcccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggagg

SEQ ID NO: 3501 - DNA, 1353 bp, Homo sapiens
ttggactgaggagcggacccggccgggcgcaggggctggactggcggagcaggtggggtccgcggccgccggagcgttccggtcggcgtctgggcatctcggcctcggcagaaagcgcgacggccctgctgcgcggggcccgcggcgatgccgttcctgcacggcttccggaggatcatcttcgagtaccagccgctggtggatgcgattctgggctccctggggatccaggaccccgagcggcaggagtctctggaccgacccagtcacctactacacggccttgcacatcgccgtcctgcggaaccagccggacatggtggagctgctggtgcatcacggggccgacgttaatcggagggaccggatccacgagagtagccccttggacctggccagcgaggagcctgagcgcctgccctgcctgcagcgcctcctggaccttggagctgatgtcaatgccgctgacaagcatggaaaaactgctctgctccatgctctggccagcagcgacggggtgcagatccacaatactgagaacattcgtctcttactggaaggaggggcagacgtcaaggccaccaccaaagatggggacacagtgttcacctgcatcatcttcctgcttggtgagaccgtgggaggggacaaagaggaggcccagatgatcaaccgcttctgcttccaagtcacacggctgctgctggcacacggggccgaccccagcgagtgcccagcccacgagtccctcacccacatctgcctgaagagctttaaactgcacttccctctcctgcgcttcctcctggagtccggagccgcctacaactgctccctgcacggtgcgtcctgctggtctggctttcacatcatctttgagaggctctgttcccacccaggctgcacggaagacgagagccatgcggacctcctgcgcaaagctgagactgtcctggatctcatggtgaccaactctcagaaactccagctgcccgaaaacttcgatatccaccctgtgggcagcctggcggaaaagatccaggccctccacttctccttgaggcagctggagagctatcccccgcccctcaagcacctgtgccgtgtggccatccggctctaccttcagccgtggcctgtggatgtgaaggtcaaagccctgcctctgcccgacaggctgaagtggtacctccttagcgagcacagtggctccgtggaagatgacatctgataggtctcaggctacaggaacgggggacacgggcagctcaggtcagcctgttggtagatgctgggacagcattagaagagggtctttttgatctgggagatgagacgggatccttcatgaga

SEQ ID NO: 3502 - DNA, 4073 bp, Homo sapiens; identical to SEQ ID NO: 2186

SEQ ID NO: 3503 - DNA, 560 bp, Homo sapiens
agaccaaggtgagcagctcctacccgatgcttggctcttgattctcagggtcgcggagaactggccgcgggcgtccggggccgggaacagaaagcgggacctgggggccatgggggatccggacagagaccgcgcttggacgtgcacgggcctggcgttcgctggtgctcagcatacggcgcggtgaggagcggcgagcacccggacgtcacctggcctggtagggaacggaacccggggcgcacaacgctatgggcggccctgccaggcctctgctccgagtacgggaaaccgcgattttaatgcggctcatcgcgaaagcttcgtcgttttgtctggctctctttaacacttttgtgagaggaaaaattggcttgcaatacatctcgctggctgtttgcggctactatcagaagttgaattctaataattagctattttataaaggtaacgagaaaaaatacactatgtctgatgaagtttttagcaccactttggcatatacaaagagtccaaaagttaccaaaagaactactttccaggatgagctaataagagca

SEQ ID NO: 3504 - DNA, 2534 bp, Homo sapiens
aaactcactgaaaatcaaaccgctaccattaggagccctccacgcttaacatatccgttctttctcgtttgaaagtaaccaggctgctcctccccatttttcgccttcttctcgcggaggctgagagactaaccttacacaacatggcggcctggtgtgtctggtgtcctagagcggacgaaagcaggtgactctctagtcaacttccgacttggactccgaagatcgctacagaaagatctagaagaggtaaaggtgttgctggaaaaggctactaggaaaagagtacgtgatgcccttacagctgaaaaatccaagattgagacagaaatcaagaacaagatgcaacaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcattagaacagttttatgatttatttgtctaggagtatgtcagaaaaatcaggcttttagtaggaattactcctattccccctgaagtcaggaccagtgcctgtgatctccattactttattttcctggaggtattagccaacacagttagatcagagaaagcaattgaagccaggcatgaaggctggcgcccgtaatcccagctactaaggctggaggatcacttcagcccaggagtttaaggctgcagtgagctatgatgatgccactgtactgcagcttgggtaacagattgagaacctgtctcattaaaaaaaaaaaaaaaaaaaaagccgttagacacacaggaaaaatccagaagggtaaactaaactaaagctacaattaatatgggaatttggaagaagtggtaggatttaaaatacagaaacagtttatgtataggatagctataagtaaatactgaaacacattatgcctctgtaattggggttgacacatgaacagaatagcagacacaatgcatatgaaagttacagaatatggtaaaagtggggtaaagatgggtttttaatgatactaagataactgaaaataggcatatagatatattccaagccgcctgacgatctaattgtaaaaagtaaagcatacaaatactagaagaaaatggaggaaaacgacattatatgtgacttaaaacctagaagaaataaataaaactattgatcaattttaactacataaaaatgtttataggacaagaaaaaccccaccataacccaaggcaaacaatgtattgacaggattccaataattaagaatacttcatacaaaaagaaatgtaaatgacctttaacatgtaaagatgctcaccttgttcagaagagaataaaccagtgtttttacctttcacttg

SEQ ID NO: 3505 - DNA, 682 bp, Homo sapiens
ggaaacctgttgagatcacagagaatatactgacggcataaaagggcagaaccatagcagggtgcgcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccgg

SEQ ID NO: 3506 - DNA, 5029 bp, Homo sapiens
actttttatccatgccagtgtcagcttctctccgaaaactgggtaatacgaaatggtctttattggttgtgaacactcgagctgagaaacattttaggatctttgtgtcttttgtgatgattttgtttctgaagaggaagctgtctaaaatattcaagtgtgcaaccaaggatttagatgaagccagcaaacaaaggaatcatgtaatcaggacctgagcgaatgtgcttactcacggcgttagttacacaggtgatttccttaagaaaaaatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccaggcattccagaagtgttcctttatggatgtaaattcaaacagtcatgctgagccatcccgggctgacagtcacgttaaagacactaggtcgggcgccacagtgccacccaaggagaagaagaatttggaatttttccatgaagatgtacggaaatctgatgttgaatatgaaaatggcccccaaatggaattccaaaaggttaccacaggggctgtaagacctagtgaccctcctaagtgggaaagaggaatggagaatagtatttctgatgcatcaagaacatcagaatataaaactgagatcataatgaaggaaaattccatatccaatatgagtttactcagagacagtagaaactattcccaggaaactgtgcctaaggccagtttcggtttctctggcattagtccattagaagatgaaataaacaaagggtctaaaatctcaggcctgcaatactctatacctgacaccgagaaccagacgctgaattacggaaagacaaaggagatggaaaagcaaaatacggataagtgtcacgtttcctctcacactagactaacagaatcaagcgtgcatgattttaaaacagaagatcaagaggttatcacgacagattttggccaagttgttctaagacccaaggaggcaaggcatgctaacgtgaaccctaatgaggatggagaatcaagttcaagttctcccactgaagaaaatgcagccactgacaatattgccttcatgattaccgaaaccactgtccaggttctttccagtggggaggtgcatgatattgttagccaaaagggagaagacatacagacggttaatatcgatgccagaaaagagatgaccccccgacaagaagggactgacaatgaggatccagtcgtgtgcctggacaagaaaccagtgatcatcattttcgatgagcccatggacatccggtctgcctataagagactttcaactatctttgaggaatgtgatgaggaattagagagaatgatgatggaggaaaagatagaggaggaggaagaggaggaaaatggggattctgtagtccagaataataacacttcccagatgtctcataagaaggtggccccaggcaatcttagaaccggacaacaggtggaaacaaagtcacagccacactccctggccacagagaccagaaacccaggaggacaggaaatgaacagaacggagctgaacaagttcagccacgtggattctccaaattcggaatgcaagggtgaggacgcgaccgatgaccagtttgaaagccccaagaaaaagtttaaattcaaattccctaagaagcaactcgccgctctcactcaagccattcgcaccggaactaaaacagggaagaagactttgcaagtggtagtctatgaagaagaggaagaggatggcaccctgaaacagcacaaagaagccaagcgcttcgaaatcgctaggtctcaacctgaagacacccctacgtcgataccttcagcttcacgtaagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctc

SEQ ID NO: 3507 - DNA, 7982 bp, Homo sapiens
ggggattggcggagcgcgaggagagaatgtgacaagtgccggctcggcggccgccgggggaggccgcgcgcacctgtccctgcccgtctcgcgccgcccgcggccgctcggacgcgcgcagagccgccccccgccgctgccgccgcgtgcgcccgcgaacatgacttctgccttcaagctggatttcctcccggacatgatggtcgagggccgcctgctcgttcctgacagaattaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagttgctcaaatgctctcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaacctattccagaataagttttgtgttggcttgtgaagcattgatgtcattttttttaattgtggactatttagatgtgtttgtgttcagcaaaatgtgatgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtcctttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcctaatacttgtttctctctctgcgtgttgtattgttggtagtcattatatgttggtgatacatctgcacacctcactgtttcacgtatctgtttttttctctatgttgtgtaaaaagatacagtcgattccacttaagtgaatatctgatttggggaagaggaaactgcacagcagccacctttgatttatgtacaaccgcccacttgaactcctgcttccaagatttatacacttttttcctacagttcacctcagtaactgcctttggggttggatttgccaaggtgttttacggtcttttgaccacacaggttaatttccccttctctcccctccctcatgagtctatccacgcagttcttaacatacattccaaactgctgcggggtttcctctccacacccacgaggccaaacccgcatcattacagtccaactcttcttagacactaatcactttctaaaagaagtgagttctccagggaagaaaaatcaacttagccagtgaaaagggttaaacttaagtctattatttgttgccctcaatcaaaagatatgtatagaaaagtcatttaaattatttatttctacaagctaattgaatccaggagcagctttaattattaacactaacggaagagaaaagaagtatttccaagggctcaaatggaagctgtactcagtccggtggaggcagggggaggtaaagtttctcacactcaagtcgtcttcatagtttactgtccttttccaaacaaaagctaataacgccatacgcatccacacactccctcctggatgaacctaagtctcgtccccactgtcaccccaaggccagttatcaaaaactgttccttctctgccctcaaagactgaagccgcaggccctgttctgcctctgctcaggaatctgattgctcttaaagtgctcttacaagattccgtcgatgtttgctccctctgtcttatctctccttccagtattttcagacgcacaagctctgactcaggccacccagcacctggcagccttcctctgcgtgccagtgaaatctctcccagtaggtgctcaggctcttcaccctctcgttgcagcagcccctctggcccgagattgtattttctagtctgctcaagaacagaggggcctggcgaggtggaggaagggaggctccctccccggggctggccgcctcagtgatggtgatgccaccagctccagcctgcacggatggagctcacttcctaccatcacttctgctttcagtctcctcatagccttcggcagtctcctctgaaaacacactgcctacgttagtgggaaaggatggctaagggtgtgatttctttttattagggaggtgggagggggatgttgggaggcatggggggtgattaaattatcatttccaaggtgcaagtgtttatttttcaaatctataagtacatagttccaccattttggcacaagacaaaatactcatgctaagcaaaggaagagaaagacaaagccagtttttgttgcttttctaaagcaacaaataattctccaaagaaggggatgaaaatgctagttcctttaagcacttactgactgtaaagttggtccctgcttaaattcatacccatagttttgagtcggtatgacaccactgcagtgtgagcaaggtgaatccgtgtgccatgcatggaccaccttgggataccgcagcaccatcaacatccgccttgctgatggaagccacacacgctgcccagcccacagcagtcgcacgcagccgatgggctcggactcttagctggcaggctaggacacacagtgaacattaatgtactgtgaatcgttcctgataagtgaataaaacattgtgaccaaacaatcagcttattcacttatcaggaatcgactgttctgctaatttgctgttgttgtttttcatctctgttgtagttcactatttttgctgtgttctgttttctcctctcatgcttgggcaaatcactgggaatattatcttcatgtgaccatgaaacgtttctattgagtgaaaatgatatcttaacaaaatctatgcacttgctatcaggaacacaatactggatgtgtcttatatatattgaactatatagtactcgatttcttaaataaagcttaagaaaggactctgttgtgtgtaaagttaatgtgattatttttcaaagcagtgtttctaaggggtatttttgttcttttaagtcttgagtgatacaggatatttttcattaaaattatatcactggctttatgacttaatattcaataaattgactttgg

SEQ ID NO: 3508 - DNA, 611 bp, Homo sapiens
agagttggcctggagagtgagcggtggagggagtggaacaaggcttcgtcaagagtccccaggagtccaggggcgcccccgagacgggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggaatcaattcatttacagctttccagtttttccagcctgcaagaggaggat

SEQ ID NO: 3509 - DNA, 2571 bp, Homo sapiens
agtagcgggccgtcggttgggcgcagacaggccgcagaagatggagagatggagccaccccaagagacaaataggcctttcagcacacttgataaccgcagcgggcaggtccaagtcctgtccgccaccccgctattgcagaggaatccctacagcagcccggatatcatgcacattaaagggtcggaggcttcttcggtcccttacgccctgaaccagggcacgacggccctgcctaagaacaagaaccaggagggcaccgggcaccggctgctgaacatgctgagaaaaactcttaaagagtctgatagtgaagaactggaaataacacaggagacgccaaatttggtgccatttggggatgtggttggctgcctgggcattcatataaagaactgcagacattttatgcctaagatcagtttacaacattatgctaatttattcattcgcatctctataaacaaagctgtgaaatgtacaaaaatgtgtagcttgctatccaaaaacgatgagaagaacactgtaattaagttcgatgaagtgaagtatttttctgtacaggttcccagacgttatgatgataagcggaataatattttattggaactcatacaatatgacaatagagaaaaacgtgctttcttgttagggagtgttcagatacatctttatgaggtaattcagaaagggtgcttcattgaagaggtccaagtgttgcatggaaacatatttgtctgcaggctggaggtggaatttatgttctcctatggaaactttggttatggattttcacatcagttaaaacctcttcagaaaattactgagccatccatgtttatgaatcttgcaccacctccagaaagaacagatcccgtgacaaaagttattacaccacagacagtagaatatccagcattcttatccccagacctgaatgttactgttgggactccagctgtgcaatcctccaaccagccatctgtagtgcgacttgaaaaacttcagcaacaaccccgggaaaggctggaaaagatgaaaaaagaatatagaaatctgaatacatggatagataaagctaactatttagaaagcattctaatgccaaaattggaacataaggattctgaggaaactaatatagatgaggcatctgaaaacacgaaaagtaatcatcctgaagaggagcttgaaaatattgtaggagtagatatccctcttgtaaatgaggaagctgaaactactgcaaatgagttactggataatgattctgagaaaggcctgactataccaactttgaaccaatcggaccaagataattcaactgctgatgcttctaaaaatgatgaatcaacaccttcacccacagaagtgcactcattgtgcactatttctaaccaggaaacaataaaagcaggcagaataccacctttaggtgaacgtcaatcagaaagcatgccagacagaaaaatgaaaaatgtattttttccattagaagtaaaattaaaagataactatccaagcattttaaaagcagactcatctctatcagaggtaaatttgaggagtatctgtataaatccaaagagcaggaacttagattcatctccaacagaaattagctggcaaaacaacaatctaaacttagctgaaagggagaacacaggcttagtttccaccagattaaaaattaaaaggtagctttcaaagccaagacccaaaagaaggccttgagctcaaggtgtctgcccttatattagaagtataagactagggagacaaaataatctattttaaaaaattaaatacaaataaatcgaaaatgcattcaaatgtctccaagtggaaatgtgtctaagtatattaaatattcctgctttacttatatcaatcaagaaatgaggataaaaaactttcaagaaaagcaaagtgatttgagatgccagtaatacaaattaatctcttgggttagtaattcagctgaaagtgtaacgacaataacaaaatgtaaattcaaaggaaatttaaaagcctgaggagttatttcagtggaaattcttaataaaactattatattataggaaataacatgttctccttattacaaataattttatagtttaaaatgagaataagagtgtgaatttaaaggtacaccaaataatagactttctcaaaatgacagccattctacttatatctttatatcttattggaataactattacaggtagttcatcaaatggtataaaaagatatataggtcagaagataaagaatttgagttctaagtgagattctgcttctaaatactagcttgggcatctaagtctctagacctatttttctcattatttgaatggtagatcagactaggtcatttctaaattctctcccaaatttcaaaagacataattttaactgggaattactctcagttacctatgtcaaataacattcttgttttttctgaatgtgaaagtaatgcacagtcacagaaaatttagaaaatggagagaaatgtaaaagaaaaaataaaagcagttataattctactgctagatttaacaa

SEQ ID NO: 3510 - DNA, 587 bp, Homo sapiens
gggaatttccttgtgcctccattcccgggaggggggagcggcgttggaggccaccgtttccagatgaggaaactgaggccttggactagaacagaggtctcctgactcagtccaggactctttctattacatcatgcggcctgatatttgtctttatggaactcagcaacatcacatacaggggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaa

SEQ ID NO: 3511 - DNA, 567 bp, Homo sapiens
gtaaaaggccactgactcctacttcctctgtatagagcaactgttgaactcagctgcctgtagagcgagaataggacagactcgtataccattctgatctgggtgcatttcttcagaaggtacgctgtcctcacgggaaaccgcccgccactgcctgggtttggggctgatgaggccaggaagaaacttaatgcgtgcactctaacaaaaagatttcccaggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattaccca

SEQ ID NO: 3512 - DNA, 958 bp, Homo sapiens
gcggcggcggcagcggcagcggcagcggcgctgagttttgtctcccgggccgtctgggcgcgcgcgggtgtcccaggtaccccgccgcctccctccttcccgcaggactcgtccctcctggccctgggccccaacggtgcccgcctgcccggcggtcggtcagcgcacagggcacggcttcctctgcttctcccggaccacttagtctcaacccgggtgtgtttgcactactagagaatgaaatatgactgaggactctcagagaaactttcgttcagtatattatgagaaagtggggtttcgtggagttgaagaaaagaaatcattagaaattctcctaaaagatgaccgtctgggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaat

SEQ ID NO: 3513 - DNA, 3250 bp, Homo sapiens
gagtcaggaatggagagaagggtaatggtgttacctcttattgtggaaacctgttgagatcacagagaatatactgacggcataaaagggcagaaccatagcagggtgcgcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttctctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 3514 - DNA, 822 bp, Homo sapiens
cctctctccatttctctgaaaatgaactacacagtttgggggtgagttggcaggggctgcttcctgagcaatactgaacactgcgcagcttgcagaggtctcctggcagccctcattaggaattctgtctggccccgatcagaatactggagacgagaccacgagattgatgagtttgccttgggagtcggtaagaaggtgaagccaggggcgaacatgggtcagaaggtcactggagggatcaagactgtggacatgagggaccccacgtacaggcccctgaagcaggagctccagggtctggattactgcaagcccacccggctggatctgctactggacatgccccctgtgtcctatgatgtccagctgctgcattcatggaacaacaacgaccgatcgctcaatgtctttgtgaaggaggacgacaagctcatctttcaccggcatccggtggcccagagcacggacgctatcaggggcaaagtcgggtatacccgtgggctgcacgtgtggcagatcacgtgggccatgagacagcggggcacacacgccgtggtgggggtggcgacggcagacgcccccctgcactctgtcgggtacacaaccctcgtggggaataaccacgagtcctggggctgggacttggggcgcaaccggctctaccacgatggcaagaaccagccaagcaaaacatacccagcctttctggaaccagatgagacattcattgtccctgactccttcctggtagccctggacatggacgacgggactctgagcttcattgtggatggacagtacatgggagtggcttttcgg

SEQ ID NO: 3515 - DNA, 427 bp, Homo sapiens
aatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgggaggcagagaagctcccctctggctctagttggagaatcccaacccaagcaagtccatccttaaacaataaacatctccagcattgctggctttggaagaccccatggtgagatgctggagcttttttccgctccagatttcgcttctaaatatttacttttactttccatgttcacttataggccagggtttttttttcctaccattgaattatttcgtcatgttctatttaattattgctttaattggcattggtgaccacaaataataataaatactat

SEQ ID NO: 3516 - DNA, 578 bp, Homo sapiens
agaaagaaaaggtatcagtacagaaaagaagagtcagaaaataccgtgcaaaggcacattcagaacgtaaccaggatagctggagccaggattcaaggagagagggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactgg

SEQ ID NO: 3517 - DNA, 583 bp, Homo sapiens
ttttgatgaccagcgcaggatgtcattgcatctacatggagcagattgtgatcctaaaacacagaatgaaatgaatatatgtgaagaagaatttgtagagtataaaaacagggatgccatttcggcattgatgcctttgttctctgaggaagaaagcagtgatggaagcaagcacaataatggtttaccagatcatatctcagctcaactacagaacacctacactctgaaagcctttactgttggatctaaatgtgttgtgtggtcaagtctaagaaacacatggtctaaatgtgagattttagaaacagctgaagaaggaacaagggttttgaacctttcaaatggtatggaggagatagtgaaccctgagaatgtctggaatggcatacccaaattggataagagtccacctgaggctgtatcccaaagagtagggaaagatctttacttcatgtcagtgggtgataccactattaaagaaaaggggtttggaggtgatggagatttaaccgtggatctatagctgtggccaatcagtcagaagctgcccttgaacaagtggcatcttacgcagaccaac

SEQ ID NO: 3518 - DNA, 3745 bp, Homo sapiens
cctgagaagccagccaggctgcggctgtttgtggcaggaggcccccacccacagcactggaccaagcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccggggtccatcattagcagtcctcacatgcgccggagagctacatcaacacgagagtgtccatctcgcccacaccagactatgcccaactcatcttccctcctgggctccttattcgggagcaagagagggaagccccctccccaggcccacctgccctcagccccagccctggccacccccccacccaccggtggtcctgcctcacttgcagcactctgtggctggccaccacctggggcccccagaggggctgccgcaggccgccatgcacgggcatcacacccagtactgccacatgcagaaccctcccccgtaccaccatcaccaccaccaccacccaccccagcacatccagcacgcacaccagtaccaccacggcccccatgggggccacccagcctacggggcccatgcccacggccacccgccgctgccctcggcccacgtggggcacacagtgcaccaccatgggcagccccctgccccgccgccccccaccagcagcaaggccaaacccagcggcatcagcacaattgtgtagacagcctgggtaggggtcccaggctccctgaaacacctgcacaccacacagggcacgcccgggggtcgccagccgcacaccaaacccggggcacttctgttgccatctctcccctctgcccctcacggcccaaccggagccccaggagcccacagggctggtgttgtgtggaacaaaggcccagatttcatttcttgttggcaccctgggctctgctcacctcagtctgagggatgggtgggcctcagacaccatcagccttgaaacggtgagccagccaagtagtgttgaactgcctcccccactccagctctcagctccctgtgccctaatgtacatgcatatgaaaacccaacctagaaaacgaagaaatgagatacaaaaacagacaaaacaaaccccaaaa

SEQ ID NO: 3519 - DNA, 1403 bp, Homo sapiens
cagcttctggcaggatatgagctgatgcctgccccgattctacagacaccatgagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactacatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagcaaaagagccagatttctgaagatcctgagaatgtggctacagtttcagaaaagtcacgtataatggaactg

SEQ ID NO: 3520 - DNA, 1300 bp, Homo sapiens
gtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacacccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaacc

SEQ ID NO: 3521 - DNA, 489 bp, Homo sapiens
tatcaatatggtaacattttgatagattctttggtattcttgtttgtgatattaagccatattcacaaaaacttgtcttttttttttttttgagatggagtctcgctctattgcccaggctggagcgtaatggcgcaatctcggctcactgcaccctccgcctcctgggttcaagcgattctcctccttcagcttcctcagtagctgggattacaggcacgcgccaccacacctggcatggcggacaccgacctgttcatggaatgtgaggaggaggagttggagccatggcagaaaatcagtgatgtcattgaggactctgtagttgaagattataattcagtggataaaactaccacagctggcaatcctttggtccagcaaggtggacagccactcatcctgacccagaatccagccccaggtctgggcacaatggttactcaaccagtattgaggcctgttcaggtcatgcagaatgccaatcat

SEQ ID NO: 3522 - DNA, 659 bp, Homo sapiens
ggcggaagatggcgacgcccctcgggtggtcgaaggcggggtcaggatctgtgtgtctcgctttagatcaactgcgggacgtgattgagtctcaggaggaactaatccaccagctgaggaacgtgatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagaggtagaggtgctatccaagcagctggagaaagagaagctggcctttgaaaaagcgctctccagtgtcaagagcaaagtccttcaggagtccagcaagaaggaccagctcatcaccaagtgcaatgagattgagtctcacattataaagcaagaagatatacttaatggcaaagagaatgagattaaagagttgcagcaagttatcagccagcagaaacagatcttcaggaatcacatgtctgacttccggatccagaagcagcaggagagctacatggcccaggtgctggaccagaagcataagaaagcctcagggacacgtcaggcccgcagccaccagcatcccagggaaaaataaaatggccgccgctttcctgttctctggctgtaa

SEQ ID NO: 3523 - DNA, 505 bp, Homo sapiens
cggacttggagtcagagagacctggctgcgaatcccggctccgccactttctagcgctgtgaccttggttttcaggtggcgaaactgactggtctggttagagcgcgtccaagccaagccgcagtgctgtttggatttttaaatttctccttctgagtgagaaaatagcaatcgagatggaaccatccgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaa

SEQ ID NO: 3524 - DNA, 1839 bp, Homo sapiens
ttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctccca

SEQ ID NO: 3525 - DNA, 676 bp, Homo sapiens
tgatgatgcatccctggaagacctgggagccaggtctggctccttggactgtatcttccgtgctccagtgggagtacagactgagagggagaagggggctgggtagagatgcagcccatgtcgtttggctgggatcactcgcttcacaaaaggaaaagacttcctcctgtgaagagatccttagtatactacttgaagaaccgggaagtcaggctacagaatgaaaccagctactctcgagtgttgcatggttatgcagcacagcaacttcccagtctcctgaaggagagagagtttcaccttgggacccttaataaagtgtttgcatctcagtggttgaatcataggcaagtggtgtgtggcacaaaatgcaacacgctatttgtcgtagatgtccagacaagccagatcaccaagatccccattctgaaagaccgggagcctggaggtgtgacccagcagggctgtggtatccatgccatcgagctgaatccttctagaacactgctagccactggaggagacaaccccaacagtcttgccatctatcgactacctacgctggatcctgtgtgtgtaggagatgatggacacaaggactggatcttttccatcgcatggatcagcgacactatggcagtgtctggctcacgtgatggttctatgggactctggg

SEQ ID NO: 3526 - DNA, 3232 bp, Homo sapiens
cttctctccccaccccacccccactactccctcacattgaccagtgtcctgggcctttaagagttggatgggctggactggagagagctcacacctctccccttcttactgcttccctccggctataacttgccagtcacagcagccagctgctgtagaagaggggaggaaacaagccagtgcaaggggagcaaaagagaaaaggagccaggctgggcttcctgatcccacagcatcgcagagctcgggaggcacagctcacagacacaggaaacacaggactgctattctgctctcctgcccacggtgatctggtgccagctggtggaacagtgggtgatggcgtccctgctgcaagaccagctgaccactgatcaggacttgctgctgatgcaggaaggcatgccgatgcgcaaggtgaggtccaaaagctggaagaagctaagatacttcagacttcagaatgacggcatgacagtctggcatgcacggcaggccaggggcagtgccaagcccagcttctcaatctctgatgtggagacaatacgtaatggccatgattccgagttgctgcgtagcctggcagaggagctccccctggagcagggcttcaccattgtcttccatggccgccgctccaacctggacctgatggccaacagtgttgaggaggcccagatatggatgcgagggctccagctgttggtggatcttgtcaccagcatggaccatcaggagcgcctggaccaatggctgagcgattggtttcaacgtggagacaaaaatcaggatggtaagatgagtttccaagaagttcagcggttattgcacctaatgaatgtggaaatggaccaagaatatgccttcagtctttttcaggcagcagacacgtcccagtctggaaccctggaaggagaagaattcgtacagttctataaggcattgactaaacgtgctgaggtgcaggaactgtttgaaagtttttcagctgatgggcagaagctgactctgctggaatttttggatttcctccaagaggagcagaaggagagagactgcacctctgagcttgctctggaactcattgaccgctatgaaccttcagacagtggcaaactgcggcatgtgctgagtatggatggcttcctcagctacctctgctctaaggatggagacatcttcaacccagcctgcctccccatctatcaggatatgactcaacccctgaaccactacttcatctgctcttctcataacacctacctagtgggggaccagctttgtggccagagcagcgtcgagggatatatacgggccctgaagcgggggtgccgctgcgtggaggtggatgtatgggatggacctagcggggaacctgtcgtttaccacggacacaccctgacctcccgcatcctgttcaaagatgtcgtggccacagtagcacagtatgccttccagacatcagactacccagtcatcttgtccctggagacccactgcagctgggagcagcagcagaccatggcccgtcatctgactgagatcctgggggagcagctgctgagcaccaccttggatggggtgctgcccactcagctgccctcgcctgaggagcttcggaggaagatcctggtgaaggggaagaagttaacacttgaggaagacctggaatatgaggaagaggaagcagaacctgagttggaagagtcagaattggcgctggagtcccagtttgagactgagcctgagccccaggagcagaaccttcagaataaggacaaaaagaagaaatccaagcccatcttgtgtccagccctctcttccctggttatctacttgaagtctgtctcattccgcagcttcacacattcaaaggagcactaccacttctacgagatatcatctttctctgaaaccaaggccaagcgcctcatcaaggaggctggcaatgagtttgtgcagcacaatacttggcagttaagccgtgtgtatcccagcggcctgaggacagactcttccaactacaacccccaggaactctggaatgcaggctgccagatggtggccatgaatatgcagactgcagggcttgaaatggacatctgtgatgggcatttccgccagaatggcggctgtggctatgtgctgaagccagacttcctgcgtgatatccagagttctttccaccctgagaagcccatcagccctttcaaagcccagactctcttaatccaggtgatcagcggtcagcaactccccaaagtggacaagaccaaagaggggtccattgtggatccactggtgaaagtgcagatctttggcgttcgtctagacacagcacggcaggagaccaactatgtggagaacaatggttttaatccatactgggggcagacactatgtttccgggtgctggtgcctgaacttgccatgctgcgttttgtggtaatggattatgactggaaatcccgaaatgactttattggtcagtacaccctgccttggacctgcatgcaacaaggttaccgccacattcacctgctgtccaaagatggcatcagcctccgcccagcttccatctttgtgtatatctgcatccaggaaggcctggagggggatgagtcctgaggtgggcatttcacgggaagggttggtgtgctggctttagacggggagaaacatctggaaggatgctcgagagaacaaatggaggtggtgaaaatcaagctttggattgtgcattcctaggcacaaaattacctcattcttcctaacaagcaatctgggacctgattttccaccttttttctcttttcttcccttcctttgttttcataagcctttggtatctttcctgcccttttcctttgtgtactctatactggagttcccttcttcctcttgctgtaggctcaatcccataccgacatctacaactaatctttcccatcaactctgtgtgaaggcaggttgcaactagaaattcagaggggcttggaatagagaaacctaaagaagcatcatcccctccatccccaacttcctcaaagcccaaagccaagggaaggataaatcaaggctcaaggcttccccagcaaagattagggaaagagacttgaccccaggactgtactacgactcttaagagaacactgcacagcactcaaagtcccccactggactgcttcctccttagccccactggtataaatacatctctctccaatttggc

SEQ ID NO: 3527 - DNA, 1591 bp, Homo sapiens
agtgccaagagcagcggttgttggagtgtaactgccatgctcagccgcgatggctggggctgccgggcgcgtccaagatcgcgccctgcggcggtttcccatcaccctgcctgtgggcgacttgagcaacttgcatcttaaggaagagaaaatcaaaccagataccaatggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaagagcttcggctcccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggt

SEQ ID NO: 3528 - DNA, 1517 bp, Homo sapiens
gggggaatttagagcctcgaggcctggggtggggacgcgaggacaccagcgtagaagagcttacatcagaatcgagctttgtgggcgctccgggatttggccctttagcgcggatcctagacaacaggttttggacctcgagagctgcagaactgaggctactggtgccgccagcctgctggctccgcctctgcctcagtttcttcccctatggcccgcgtgccgctggggcggagtctcactctgtcacccaggctggagcacaatggcatgacctcagctcaccacaacttccgcctcccaggttcaagggattctcctgcctcagcctcccaagtagctgagattatagatttggagtggtatgagaagtccgaagaaactcacgcctcccagatagaactacttgagacaagctctacgcaggaacctctcaacgcttcggaggccttttgcccaagagactgcatggtaccagtggtgtttcctgggcctgtgagccaggaaggctgctgtcagtttacttgtgaacttctaaagcatatcatgtatcaacgccagcagctccctctgccctatgaacagcttaagcacttttaccgaaaaccttctccccaggcagaggagatgctgaagaagaaacctcgggccaccactgaggtgagcagcaggaaatgccaacaagccctggcagaactggagagtgtcctcagccacctggaggacttctttgcacggacactagtaccgcgagtgctgattctccttgggggcaatgccctaagccccaaggagttctatgaactcgacttgtctctgctggccccctacagcgtggaccagagcctgagcacagcagcttgtttgcgccgtctcttccgagccatattcatggctgatgcctttagcgagcttcaggctcctccactcatgggcaccgtcgtcatggcacagggacaccgcaactgtggagaagattggtttcgacccaagctcaactatcgagtgcccagccggggccataaactgactgtgaccctgtcatgtggcagaccttccatccgaaccacggcttgggaagactacatttggttccaggcaccagtgacatttaaaggcttccgcgagtgaatgagtgcttcttaatcctaaaaacacaatggctgaattatctttctccatgtggcgctgaatcacccatctggtttggagctagagttgcttcctggtgagagaggaagcaactctccttctggttgtctgcctcccctcagatttcctgataggctgatggcatgtggctgtgactgtgactgtaatcattgctgaacaacatctctttgaatcaaaggttgattttcccagagggtgctgggtcaggcatttctattaggagttggaaagcaaaaatgggtccatagacactctatggaggtgtccctttctgctctttgctgtgtcctttcagaatttttaccaggaacataatgtggatgtgacttatgaacttaaatata

SEQ ID NO: 3529 - DNA, 871 bp, Homo sapiens
actcctcacaccacttaacagccacttgtttcatcccacctgggcattaggttgacttcaaagatgcctcagttactgcaaaacattaatgggatcatcgaggccttcaggcgctatgcaaggacggagggcaactgcacagcgctcacccgaggggagctgaaaagactcttggagcaagagtttgccgatgtgattgtgaaaccccacgatccagcaactgtggatgaggtcctgcgtctgctggatgaagaccacacagggactgtggaattcaaggaattcctggtcttagtgtttaaagttgcccaggcctgtttcaagacactgagcgagagtgctgagggagcctgcggctctcaagagtctggaagcctccactctggggcctcgcaggagctggggttcagacccagggtcaggccactggctctgcgtgggtcagcagctatgacaggcaagctgagtcccagagccaggaaagaataagcccgcagatacaactctctgggcagacagagcagacccagaaagctggagaaggcaagaggaatcagacaacagagatgaggccagagagacagccacagaccagggaacaggacagagcccaccagacaggtgagactgtgactggatctggaactcagacccaggcaggtgccacccagactgtggagcaggacagcagccaccagacaggaagaaccagcaagcagacacaggaggccaccaatgaccagaacagagggactgagacccacggtcaaggcaggagccagaccagccaggctgtgacaggaggacatgctcagatacaggcagggacacacacccagacacccacccagaccgtggagcaggacagcag

SEQ ID NO: 3530 - DNA, 682 bp, Homo sapiens
ggaaacctgttgagatcacagagaatatactgacggcataaaagggcagaaccatagcagggtgcgcctcgcagtcacctctgtgccctgctggttgtcttcccagcgctgctgtagttgccttccatggatctataggagagcaagtcctccaggagaagaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccgg

SEQ ID NO: 3531 - DNA, 1960 bp, Homo sapiens
gattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctcacagtgctcgacggcacctctcggccctccaggtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtgga

SEQ ID NO: 3532 - DNA, 474 bp, Homo sapiens
gagcccgtctattttgctgagaaggtgatgtcattaggcagaaattggcaccgaccgtgtctgaggtgccagcgttgccacaagaccctgactgctgggagtcatgctgaggtgtgaacattggcgatgtgggctgctacatctatgacccagtgaagataaaattcaaatgagacgctcacaaaaaaggtcaccctaactcaggcctcccatcatgcccctcatggtccaatggaagctacaaaaatctccagtcccatgggggttggggaaggtgggatcttgggggcctgggcctaggctccatggtaggccagagagtctagactttctctgccaattttttccctttcccatttctatctggttagggaacagcccgttttgaagggtatcctcctcctggccatcacaacccctttccccagcacattctggagcttcaaggtactcataaaacttgtgtttattgaa

SEQ ID NO: 3533 - DNA, 3424 bp, Homo sapiens
acaacgctacttccggtctcctcacttccggcttcgctgctcttggttctggttctggaggctgggttgagaggtcgccggtccgactgtcctcggcggttggtcagtgtgaatttgtgacagctgcagttgctccccgcccccgagcagccgaggagtctaccatggctcaagaatctcccaaaaattcagcagcagaaattccagtgactagtaatggagaagttgatgactctcgtgaacatagctttaatagggatttgaagcattcattaccatctggacttggtctctcagaaacccaaattacatctcatggctttgacaataccaaagagggtgttattgaagcaggagcatttcaaggttccccagcaccgccactgccatctgttatgtctcctagcagggttgcagctagtcgactggctcagcaaggaagtgatttaattgttcctgcaggtggccagagaacacagacaaaaagtggaccagttattctagcagatgaaattaaaaatcctgcaatggaaaagttagaacttgttagaaaatggagtctaaacacctataagtgtactcgacagattatctctgagaagctaggccgtggctcaagaactgtggaccttgaacttgaagctcagattgatatattaagggataacaagaaaaaatatgaaaatattttaaaactggctcaaacattgtcgacccagcttttccagatggtacatacccaaaggcaacttggagatgcatttgctgacctgagtttgaagtcactagaacttcatgaagaatttggctataatgccgatacccagaaactgctggctaaaaatggagagactcttcttggggccattaattttttcattgctagtgtgaacactttggtgaataaaaccattgaagatacattaatgactgtgaaacagtatgaaagtgccaggattgaatatgatgcatatcgcactgatttggaagaactgaatcttggaccacgtgacgcaaacactctgccaaagattgagcagtcacagcatctcttccaagcacataaggaaaaatatgataaaatgcgcaatgatgtttctgtcaaattgaaatttctagaagaaaataaggttaaagtattgcacaatcagctggtccttttccacaatgccattgccgcttactttgctgggaatcagaagcagcttgaacagacacttaaacagttccatatcaaattgaaaacccctggagtggatgccccatcttggcttgaagaacagtaaaatcacagcggaaaataaaaagaaagtcgcgttgttatatttctaaaccaacctaacaagaattaagcagagttgggggaagtgggaggggtgacaagcattatagtgattcttgcacaaacagctttaatttttccctttttcatactttaacaattgaactgttaagggtggttttaatgtaaacatagtttctataatctgaacacaataattttcctttttgagaaatccttttgtattgtgagggttgatggctatttctgtagtttgaaaacatctaatagagatttgcactgacaagataaaaattcaaggtttttggtcctggaaatgagggccgattgtaacttttccaaagggaggtttacatgatttgtatcaacatcagatattttatatgtgaatatattaaacatctttaagagattcattttcatgtattaaagaaaaaagaaactattttgcagagtaaagttatatggtgttcctgcagcgtccacacagaggcagcagctctaatgaatgattagcttgtggagttgtggcaaatacctttttaaaaatgaatctgtaccactgtaattttatttagacttttttttaaagacacagaaatcacactgtcatttctgtgaggcttttaagcttatgaatttgcttcacccgaagtcattggacagttacatttgcaatttcttttggttcataacaaaacctgcttaagagaatttttttttttgacaggtggacgtgggaatggaaattcttaatggtttctggagtagaaatctgtacttagaaaactagtttttgggtcagttccattttgatagaagtgaatacatagacagcttttattgacttccatatgtaacaataccgtttaagccttaaatcacagatatgtgccttctcagatacagtaattcttgttcaaccaatgtacaaaatccataaagaaacccctgttggataatgtttgatgtgtctattccttccatggaatggagcactatgtatgaatgttgggtttctttgtacttgttaagccacatttgaggtttatggtaaaaatcatcttttgagtttgctctttggtttttcttcattccttttgaggattgggaaaacagaaagattctttgatttgggtaatgaagaggtaatttgggacagtgtggtggtaccaggaagaaagaggattggaaaggccagtactgttttagttgctcggcactgttggttttgttttaatgtggttgccctgtccactacatggttctatcagtagtgtaatccattttcaatgtaaagctcttttagtttttgtcatagacataaattaatattttgagaggcatccctcacctgttcatttcttctgtgttgaaatgaagtacttaaaattaccgttatacatgaactttgtggactgtaagatttgttatatatgttcaaatgccttttagctggctttttaattaatatgcctgttttgagtgcttaatacaatgtaatgtgattgtaaatcatacctattttaaatcattccttcctgtatatttgtactcagagagccttattttattcttccagcagaattactacttgtgatagttcatttacattccccagaatgtgcctctagtgtgaattttgtattcttattaaacgtgtttgctgcagtaaatcgtttctctggaccttcatagtttaagaagtaactatttggaaattctgaagacacataatttgcgttttctgaaccttaaaaaaaaaggtacttctgtcacttataattgttttagctcagtaagctattttttttcaatgtgaatctcttttgagagctgaacatgtccattcttaaccacatttcaataacagttactgtagctaaggagctaaatagtttcatggattaatttttttcagaataaatttaaaatatccatgattctgatagtgggcacatgaccaaaagaaaaaagtaaatcaatatatttagccaatggtacatttactttgttaggaatgtaatttatgttcattatagaaaagaattagaagaaaatttcaagtaatagaagataagtaccttcccaagtgaataaatactgcatggaaccactcaa

SEQ ID NO: 3534 - DNA, 583 bp, Homo sapiens
cacagttcccggtccctagacaaccctggctctgcccgcccacttcgcgtgttcgattggcttgtccttcccctttctaagaccggagactaaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgct

SEQ ID NO: 3535 - DNA, 2663 bp, Homo sapiens
gtgcaacggccgttagaggagctgagggagggaaccaccgctcaccgcagacgtggtggctgcagtcagtcttcccgagtgagggatttcgccgcccgctttcaggcccgtttggcttaaataactgtgattgatggccatgcaggagaaatatccaactgaggggatctctcacgtcacttcaccgaatttttgcagctcaagtggcagtcctcctttccagcccatcaaaagccacgtaaccattccaacagcccatgtgatgccttctactttagggacctctcctgccaagccaaattctacacctgttggaccctcttcctctaaactccctttgtcagggttggctgaaagtgtgggaatgacaagaaatggagacctcggtgcaatgaaacattctccaggcctatctagagatctcatgtatttctctggtgctactggagaaaatggaattgagcagtcctggtttccagcagtgggccatgaaagacaagaagaggcgaggaagtttgatattcctagcatggaatctaccctcaatcagtcggcaatgatggagacactttattcagatcctcaccaccgagtccgcttccacaacccaagaaccagcacaagtaaggagttgtacagagtgttgcctgaggccaagaaggcaccgggcagcggggcagtgtttgagcggaatggaccacattctaatagcagtggggtcctccctttgggactccagcctgctcccgggctctccaagcctctgccctctcaggtgtggcagccgagtcctgacacttggcatccccgagagcaatcttgtgaactcagcacttgtcggcagcagctggaattgattcgtttacagatggagcaaatgcagcttcagaatggagccatctgccaccatcctgctgcttttggtccttcactgcccatcttagagccagcacagtggatcagcatcttgaacagtaatgaacaccttctgaaggaaaaagagcttctcattgacaagcagaggaaacacatctctcagctggagcagaaagtgcgagagagcgaactgcaagtccacagtgccctcttgggccgccctgccccctttggtgatgtctgcttgctgaggctacaggaattgcagcgagaaaacactttcttacgtgcacagtttgcacagaagacagaagccttgagcagagaaaagattgaccttgaaaagaaactctctgcttctgaagttgaagtccagctcatcagagagtcgctcaaagtggcgttgcagaagcattctgaggaagtgaagaaacaggaagaaagggtcaaaggtcgtgataaacatatcaataatttgaaaaagaaatgccagaaggaatcagagcagaaccgggagaagcagcagcgtattgagaccttggagcgctacctggctgacctgcccacactggaagaccatcagaagcagagccagcagcttaaggattctgagttgaagagcacagagctgcaggagaaagtgactgagctggagagtttgctggaggagacccaggcaatctgcagagagaaggagattcaactggaaagcctgaggcagagagaagcagaattctcctccgctggacatagcctgcaagataaacagtctgtggaggagaccagtggagaaggtccagaagtggaaatggagtcctggcagaagcgatacgattcgctccaaaagattgtggagaagcagcagcagaagatggatcagttgcgctcacaagtacagagcctagagcaggaagtggctcaagaagaaggaacaagccaggccctgagagaggaggcccagcgaagggattcagccctgcagcagctgcgcacagccgtgaaggagctttcagtgcaaaaccaggacttgattgagaagaatctgacactccaggaacacctgcgccaggcccaaccagggtctccaccttcaccagacacggcccagctggcacttgagctgcaccaggagttggccagttgccttcaagatctgcaggctgtctgtagcattgtgacccagagggcccagggccatgaccccaatctctccctgctcctgggcattcactcagcacagcacccagagactcagctagatttgcagaagccagatgtgatcaagaggaaactagaagaggttcaacagctgcgtcgtgacattgaggacttaaggaccaccatgtcagacagatatgcccaggacatgggagaaaactgtgtcacacagtgaggaattctgggggattcccccagggaggagctgggctgctgagagcctagtccagcaggtttctgccctgacattctcttgtctgctattcccagagaggtctcagaggggaggggagagcctgcatctgggggccaagggctgattagggaactgtgtcctacccacactggcatgttggattacgtttgtcctgttaattcactctagacggtgagttactaattaacttttggcaggtacaacagataagtcctcacaaactgttcccagccctaggctgacatgagagacgaacaggctgtccacctttcttctccatccaatgggatggatccatgttcattcccacttcacaccttggtcctgctgattagagagctcatcagagggg

SEQ ID NO: 3536 - DNA, 972 bp, Homo sapiens
ggcatgcctctgctcctttgcgcacgcgcgccgcttcccagtggcaagcgcgggcaggaccgcgttgcgtcatcggggcgcgcgcctcagagagagctgtggttgccggaagttgagcggcgagcagccttgtgagagacatttctgagacctgtatgtcctgcgtctatgattcttccctgatcaaggcttctcaaaccccataatgctggtatccagtgcatccgttctcaaaaactgaagctgatggacaccagattgcatgtgaaggtgaaggatattatagcagaaggaaaccaaaataaaagaaaaacagctcctggaagtaaccaatgagaaggacagataagagtttgaagactgtggatgtgactgcttgttccctggttgacacactgaagaagaaatcatgttgattcagagttggcttggaggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacag

SEQ ID NO: 3537 - DNA, 1545 bp, Homo sapiens
gccagaggagcggctccggccgccgcgcctgacccttgtccggggtcttccgcacagtgggctgagggccatgtcagttttctgccacctacaggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcaggtttcacaagctggtctgggggagctttggcagtgggcttctggaaagctccggggttattgttggcggcggggacaatggcatgcttattctatacaatgtgacccacatcctgtcttcggggaaggagcctgtgattgctcagaaacagaagcacacgggggctgtcagagccctcgacttgaatcctttccagggcaacctcctggcttcaggggccagcgattctgaaatcttcatttgggatctgaataacttgaatgtgccaatgaccctgggatccaagtcacagcagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggatgcactgctcaggcctggcctggcatcctgacatagccacccagttagtgctgtgctcagaggatgatcgacttcccgtgattcagctgtgggacttgcgctttgcctcctcgcccttgaaggtgctggagagccacagcagggggatcttgtcagtgtcatggagccaggctgatgctgagctgctgctcactagtgctaaggacagccagatcttgtgccggaacctggggagcagtgaggtggtatataagctaccaacacagagcagctggtgctttgatgtgcagtggtgccctcgggacccttcagtgttctctgctgcctccttcaacggctggatcagtttgtactctgtgatgggtaggagctgggaagtccagcatatgagacaggctgacaagatctcctcttccttcagcaaaggccagcctctcccaccactgcaggtgccagagcaagtggcacaagcaccactgatacctcccctgaaaaaaccccccaaatggattagaagaccaacaggtgtttcatttgcttttggagggaagctggttacttttggcctccccagcacccctgcccatctggtgccacagccttgcccccgcctagtcttcatcagtcaagtcaccacagaatctgaattcctgatgcgatcagctgagctgcaggaggccttgggatcaggaaatctactgaattactgtcagaacaagagccagcaagctttactgcaaagtgaaaagatgctgtggcagttcctgaagcccgccagagacagctcaggtgcaaggagatga

SEQ ID NO: 3538 - DNA, 2853 bp, Homo sapiens; identical to SEQ ID NO: 2528

SEQ ID NO: 3539 - DNA, 3546 bp, Homo sapiens
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtggtgagtatagacctggcccatgggggcagctgcaccgtgggcgtggtgagcgaggatgtgcagcggaagggggagcttcggctgcggccagaggagggggtgtgggctgtgaggctggcttggggcttcgtctcggctctgggctccttccccacacggctgaccctgaaggagcagccccggcaggtgagggtgtctcttgactatgaggtgggctgggtgaccttcaccaacgctgtcacccgagagcccatctacaccttcactgcctccttcactaggaaggtcattcccttctttgggctctggggccgagggtccagtttctccctgagctcctgagaaggagcagttacctactctcctctaagtacaggactcatatcaacccaagtaccatgtggacttgatccctggctgaatcacctggatgacttggaatagaaatgactgctttagaagatgggatggggccgggtggtaagggatagaagagaggactctcaatctactgatcaagtcctttccccaatgcccagtggatggccagggtacctggggactcaggctgctgccagttctgctcaccaccatccgtgcttggcacagaagtagctgcatagaaagggcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagtgtaaactacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattagagattgaattgctttccctgggagtgtgcagtatctcattaaaatgttgtatattcaaaaaaatacagacacacacaagtgcctatataatgataaaacatatccaaagcacccaaacctgtgattccagaaaagtagatcctatttttgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 3540 - DNA, 1641 bp, Homo sapiens
cgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtggttttacctcggatagaggtttccagtttgtttcctcgtctcttccagacatttgttatcgctgtggtgagtctggtcatcttgccaaggattgtgatcttcaggaggatgaagcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactg

SEQ ID NO: 3541 - DNA, 550 bp, Homo sapiens
agctgcgacgccgagtttcactctggctgccttctcctgagagtcggagccacagccagagccctgcccaggccgagccggagctgcagcccgagcgcggtggtgccctcagccccgtcctcttgtcctcctcagcctcggctgtttttgcagagttgtgagagttggttcatccgggccatgaggacatgttgggacataccccgtgtgccgatgatggaggcggccgtggctgcccgagagatgcgtgacacccaggagtaattggcttggaaggcagtcctctgatttgtacctcattgtggttacagaaacttccaattgaagacactgagctgaaccattccgcccgcccgcccgcccgagggcactccagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgg

SEQ ID NO: 3542 - DNA, 4307 bp, Homo sapiens
acgtgcttaggagccatattgtcgctagtggccgctggggctgggaggggtgtgctagagaggcgcagcttctctgggcgtggtttttatcctgggggaaggatcggtggaatgtgaggggaggtggaggagatggcggcgacggcccgggaagatggcgccagcggtcaagagcgaggtcagcggggctgcgagcactatgacagaggatgtctcctaaaggcaccttgctgtgacaagctttatacttgccgcttgtgtcatgataacaatgaagatcatcaactagatcgctttaaagtgaaggaagtgcagtgcataaactgtgaaaaaattcaacatgcccaacagacttgtgaagaatgtagcacattgtttggagaatattattgcgatatatgccatttgtttgacaaagataagaagcagtatcactgtgaaaactgtggaatttgtaggattggtccaaaggaagattttttccattgtttgaaatgtaacttatgcctagctatgaatcttcaaggaagacacaagtgtattgaaaatgtgtcccgacagaattgtccaatatgtttggaggacattcacacatcccgtgttgttgctcatgtcttgccatgtggacatcttttacatagaacgtgttatgaagaaatgttgaaagagctacagatgtccattatgtatgcactctgctttagatatgaccaggtattggagacagctggatgatgaagtagcacagactcctatgccatcagaatatcagaacatgactgtggatattctctgcaatgactgtaatggacgatccactgttcagtttcatatattaggcatgaaatgtaagatttgtgaatcctataatactgctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagcataaaatcatattacaagtacgtaaggattcagggtctcttgatagacttatcatagctctatattgaatgaaagccactgtgcttgtgttttgattggaaattcctttagtgtcagttttttggaagccaatgatgtttgccactgatacattcatagaagtgtattatattttcatgaagctttgctttaagtgacactacgcgtgcagttcatttctagttcttgatagaactgcacttaattttcagtagtagtcttgactttttaagggctgtgttatattaagttctcccttactgttaaaacctaattaaatatgctttagaattttctaagacagtcctctggatcctctaaatgtgaattttgatgtaataactgctaataaaattatattgaaactgttttatagaaagttttttccaaagttttctatgtttggctcaattagggcagtatcatcagttctataatgtaaaagaaattttctttcttttgaggtattccataaaagtagttgggaaaattattatgtaaaataataagactcttccaaagccttaataaaaacatcaacattgaaaacagttttttttaggttgcccaaaattatttcttcaaagagtcattcattccttcatttagcaagtatttattgagcaactgctatgtggcagatatgtttctagatgctgtagagacaacagtgaacaataaagataaaagtccttgtcctcacagcagtacattctattgttcatcatatttgatcaatgtactcatttttctttatgcaaggagtggatgtcttattgtaaatgaatagaatatttcttccctaagcgtgtgaaaataggggatggatgagtgggaagggcatgggatattcctggcaagatctctgatttcataatacttttttgggctcatgtagtggaattaaatatacctcttacttcaggaacaaagttaacaaatatgtttgatgatccagccgactttgacactgttatctccgtaatagctttaccattaggctaggatgtaaaatgtacatttatcagttgataagtacctattgagcaccagttgtatttccaactttgagctatttgaatcttctttgaataaggaagttagccttttaactagaaagcctaagagttctggcacatttatttcttcttttgttgaaatttattcacctagataaaggcagcagtttgggactcagatctttattttatcccaccttcttgtcttctgtattccactcttcttatgttctttcccttcatctgtttccttggcctggccagagcagcagtgctgatcttcatttgggaaaggatgttcctgggtattaccaattagtatacagataagtaaagactagttttccagatctaatacttttttttgaagtggttttgctctgtcatttaggctagagtgtagtgaagtgatcgtagctcactgcagccttgacttcctgggctgaactgatccttccacctcagcctcctgagtagctgggactacaggtgtgtgccaccatgcccagctaatttttaattgttttgtagaaacaaagtccaggctggtcttgaactcctgggctcaagcatttctcctacctcggccttccaagggctaggattacaggcatgagccactgtgcttggtccagatgtattactttttatgtttggtattattctgccaaaccaatcatgttattgtttttaatcattgaatcattggatctttaaataggagtgagtatataataataaggctcttctgttttcaacatctgtgctgggtcatgcattagcattaattactacaatgattctgtggggtaagtgttgtcctcatagacaagaaagctgaggtttagaggttaaaatgacacattgggggtaaataacagacactatatgttggagttgggaatcagatccaagtttgactccaaacccacttttaccacattgcttttgatctaaacttctattttgctaaaatacccctcacagctagtcatccatatcattgaagcgctcatgatttgatagattaacctttcatttttttaggtgactctagttagaaagtcttatttcacaatctgattgtttctttaacttaggatccaaacatgtccaaaataatgcagagtacatatgcaatcactcgtttatgctgtctagtcatgcacttaaagcaattttcaaatgtactcaaagtctctaggcttcggtacccagggttgcttcaagtatttgttcatgacacgtcaactcgatgattaaaatccttcaacacttctcattcacaataagaataaaatctacatcccttaccattcagtatgcaaaacttaaaatacataactttacccttaaatattttttctttctctgacttcataagtataggttatacctctataagaaagaaggtaaaaaactctcaacaatcccttctttcagagagaactactgttaacattttaacagacaacttcattcttttcctattcttttttataatgcttacaggaatgttaaatacttagacagatcttaagtacactagaattatctgtccctgaaataagttaggttgccctgccgcagaatttgtatctatagtttatttggattatttttgaaaaaagtaaaataacaatacccttacgaattttttggtgcatagcatctcagcttcttttatcattaaagatgtatgtataaaaaaaaaatgagtgtatatcaagttgttcatttcttagtttctggggtcttcttaaccagtacatagaactctttatgaattaactttagcttatgttggaagtagtagtttgtttatagtgtcatggattttaaaatcaaactcagtttttatttcttcactaaaacctattttcatatgatatacatgttaaatttcccttttattttggtcatgcatcaaaataaatttactaagtactaaagagccaacattattttataagtgcctggcaataggtattcactagttgaatagtttaatttgaaatgaattaattttaaatgggagttgttcaaaactatgccactttttcttttgtcctttgtgttattaaaatttaattgataattgtgtatattatatatatggagtacaatgtgatgttttgatatatgtttacagtgtagaatgattaaatcaatgtaataaatttattgcctcataccattttttgtggt

SEQ ID NO: 3543 - DNA, 646 bp, Homo sapiens
gcggaagatggcgacgcccctcgggtggtcgaaggcggggtcaggatctgtgtgtctcgctttagatcaactgcgggacgtgattgagtctcaggaggaactaatccaccagctgaggaacgtgatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagaggtagaggtgctatccaagcagctggagaaagagaagctggcctttgaaaaagcgctctccagtgtcaagagcaaagtccttcaggagtccagcaagaaggaccagctcatcaccaagtgcaatggtaggcgggaggcccgtgctctccaccacggttatataaacgggctctttcctaaccacccagtgcctgtgtcaaaggcagggtttcactctaacacctgtccccagctgaggatacaggcaggcccgggtgggccacaccttcgaaaaggccttaagggaccaggcaggccacggaaatgagggaagcagtcggtgtactatattcttcaccgccataaaggaatgggcttgctcccatttttcctgaaacat

SEQ ID NO: 3544 - DNA, 950 bp, Homo sapiens
ccccaacccccctgctgggccgggtaggcgtttcagtctttcgcggcccgggagctcagcagagctaccagctgccctgttggcttcgctggtcggatcgtcctcctggccccgccaaacaggcggggggagcggccccgactgtggggccatggcagtagtctcctcgttcgccgccgccgctagcctagctgagtcgccggcttctgcgctaggggctcccaccgcctccgcaggctaaggagccgctgccaccaacgagctgtgagggttactatgctccctctttgccgccgtctcctcctcttgcccgcgcaggcacccctctggctgctcagtcctgcctcagtgtcaaaccagaagagaagtaaaattcaacaaaaatttatgtgtggagttccttcttaaaagaagaaaaaagtgattatttagactatggatcggagcaaacggaattcaattgcaggatttcctccacgtgtggagcgtcttgaagagtttgaaggaggtggtggaggagaaggaaatgtgagccaggtgggaagagtttggccatcttcgtatcgagctcttataagtgccttttccagactgacgcgtttggatgatttcacctgtgaaaaaatagggtctggcttcttttctgaagtgttcaaggtacgacaccgagcttctggtcaggtgatggctcttaagatgaacacattgagcagtaaccgggcaaacatgctgaaagaagtacagctcatgaatagactctcccatcccaacatccttaggtgcagaagtatgaaccagaatttttccccaaattgagattagatctacattgggaagaatccatctcttggaaccctaggattacacagatgtgccttctcaggtcctagtccaatggaggttgggtagaggtggaaggagagctcattttcacctagaagagggcctca

SEQ ID NO: 3545 - DNA, 4617 bp, Homo sapiens
actgccgctgccgcggctacctgcggttcatctccgcacattccacacgcggcccaaacggtctctctctctctctctcaaacaccgcctttccgtctttgttttatcttgagtagcttagaaagattggagaagaaagcttacgtggaatgaaaatcaacttttatggatattttgaggactaaaagaataaatagggcgtccgtactgtagcgaaagtgcgactaaggttaggcatctggatttcccccgtagccctctttcaccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcaggtactaacttttgcgggggataccccaagatctctcagcgcccccgggtgggaggctgtggattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggagtcgcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgtactttacagcctcctgtcctgtaggttgtctgaagacctcgtaaccccttccccacccctgccccagtgcaggtctgggaaaggggagagtggtgcgttgtgaagcgcagaaagacctcaagtgtctgggcaagcctgttttgagtcgggtgtggcctcttaggggctgtataccctggggtttcctgggtcaggaaacttcttagtatttctctttccctggtcccctatcaggggcttgaatttgaatattcagttggagaatgcatttaaaatacacccatagtaaaatctccataaaatgc

SEQ ID NO: 3546 - DNA, 521 bp, Homo sapiens; identical to SEQ ID NO: 1926

SEQ ID NO: 3547 - DNA, 596 bp, Homo sapiens
agacaaagcctgaatcctggaaaaagccaactctttgaacaggaattagagtgtgatcggctcagttgacgtacagggaaacctttatttgaagccgataaatgacttgtcgtgggcgagcccttcgggtgctattaatactttcgggtcacagcggagactctggctgttgttcagaaaagaactacgaatcccagaatgccctgttcccccattttcccctcgagaatccaaggcattgtcctacataatggtagaggacgaactggcacttttcgataaaagcataaatgaattttggaataaattcaaaagtacggacacctcctgtcagatggcgggactaagagatacctacaaggattccatcaaagcatttgcagaaaagctgtctgtgaaattaaaggaagaagaacgaatggttgagatgtttctggaatatcaaaatcagatcagcaggcaaaataagctcattcaagaaaaaaaggataacttgttaaaattgattgctgaagtaaaaggcaaaaagcaggaattggaagtactgactgcaaatatccaggatcttaaggaagaatattctaggaagaaggaaa

SEQ ID NO: 3548 - DNA, 620 bp, Homo sapiens
gttcttccgcaccttcctcagggaggtcccgctggccaaggtctggctgtccctcctgtcctctgcccccgcctcccttccaccggtccccgacgtgccgccagctcccagcccagcgtcccgcagggcggtgcgggcagatgccgccgaagcgtctagcgggaagggcgccggcgcggctggagctttgtaggcagccaatcccagagaagcagacgggatggctagttcagcccgggagcacctgctttttgtgaggcgtcgaaatccccagatgcggtacacattgagcccagagaacctccagagccttgccgcccagagctccatgccagagaacatgaccctgcagcgggccaacagcgacaccgacctggtgacttctgagagccgctccagcttaactgccagcatgtacgagtacacgctggggcaagcccagaacctcattatcttctgggacattaaagaggaggtggaccccagtgattggattggactttatcatatagatgagaattctccagccaacttctgggattctaagaacaggggtgtgactggaacacaaaaagggcaaattgtatggagaattgagcctgggccctatttcatggaac

SEQ ID NO: 3549 - DNA, 691 bp, Homo sapiens
gctggaaatggccttaggggtcacctagggcctaatccatcgtttctcttgtgggggaactgagcctctgggaagggtcacattgcgttaatgcagtgtgtgtcgcctctgtccctcccccttacacgtctggcgtctcgtcagatacatgtcagctcctgggagaagctttccctggccgctttgcagaagggcgtccccttttagcctcttccacgtcaacctgctccatttctttcgtagcagttaccagtctctgaaactaagtctgtttctgtcttagcccgccaagtatttattgtatacgtatataggtgccaccgtacaggcagtacttctccaggcaagtagtattaaacaccagccgccctgggccaggcattgtactgtgggacccagtatgcattaagggaagaatccaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggc

SEQ ID NO: 3550 - DNA, 1797 bp, Homo sapiens
gctgaggacggggcggggcctcgcgctaacggtcgcgcggccgtcgcacctgcacgaggctgtggcccgagcgtcctgtggagaagccgcgaagcgcgggcgacccgggggtcgggcgggccaggtccgcgaggccgcggcggcagctgtgcaggcccggggagcagccggccgggcgagcctcggattaaaaaaatggcaaactcctttgcagcgaggattttcactaccctttcagatctgcagacaaatatggctaatctgaaagttatcggtatagttattgggaaaacagatgtcaaaggctttccagacagaaaaagtattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggttggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagatataccagaagctaacattctgctgaattttatacgagaaaataaagaaacgaatgttctggatgatgaaattgacagttatttcaaagaatccataaatttaagtacaatagttgatgtctacacagttgaacaattaaagggaaaagctttgaagaatgaaggaaaagctgatccttcctatggcatcctttatgcctacatttccacactcaacattgatgatgaaactacaaaagtagttcgaaatagatgttccagctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctgcacgttcgttctatcacacagagcaaggagtggattgaaaattagtgtactctcgtgcaagcttgcagatcctactgaggcaagcagaaacttgtctggacaaaaacatgtttaaaacggtctatcattttgaactctggaaaagtataagagttttaactccctttaaaatggaatattaatttgaaaattatggggaaaattgcattttgtttacatgtggtgaacatgtttctagaaattgttatggtggaggtggtctgggtgagtctgaaggcctctctcatctgacctcccttcttagaaggcctcctactgtctttgccttgtctcctcccaagttggaaaatgtttacatgaattaataaacagatttaatcttctacag

SEQ ID NO: 3551 - DNA, 1059 bp, Homo sapiens
gacttccggtgctggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccagtaagggaataaagaagactggaaacgtctctcccctcccctatcccagtccctcaccctaatccgcgcgcaatagaaaaggcggaagcgcctgtccacgatcagggcggggcaaggggaagaaatctcgcgataggagagcggtccgggcgggggtggcacctctccctcctcctggcgttagttccggtcgcagaggagacaccgccgcagttgccgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatg

SEQ ID NO: 3552 - DNA, 2913 bp, Homo sapiens
cccgcccgcgtggtcgtcgccaccgcagccgcccgagaggagctgggggaggacggtggcccgcgaggctcgtcgcagacaacgcggcggcgatgtccgcgagccaggcgacacaaagttatcattgttgggctggataatgcagggaaaactaccattctttaccaattttctatgaatgaagttgtacatacatctcctacaataggaagtaatgtagaagagatagtgattaataatacacgtttcctaatgtgggatattggtggccaagaatctcttcgttcttcctggaacacttactatactaacacagagtttgtaatagttgttgtggacagtacagacagagagaggatttctgtaactagagaagaactctataaaatgttagcgcatgaggacctaagaaaagctggattgctgatttttgctaataaacaagatgttaaagaatgcatgactgtagcagaaatctcccagtttttgaagctaacttctattaaagatcaccagtggcatatccaggcatgctgtgctctaactggcgagggattgtgccaaggacttgaatggatgatgtcacgacttaagattagatgatctctactgacctcttctcatagattttgtataaatgaagtgctggactttacctgaaagctgcaaaaattaatggtttagatatatttataataaactgatttaaactttttctataagaagaaaaattaagaccacttatttgaaaacaaagatgaagtctcaccttccagtttgctttctcattagttttttccaaagtaagttattgaagctgtgattgacatttttctcataatgaatcctctcaggacattgtgtagcctatggtaagtacaaagggagaggaagacattttgaattttaagagctttattatcagtttaaccctccctagttgaatgttattttcttcttgttccattaagtcagaatacaaatcagcacagatattcgaatgtttccaatattttaaaatgtaatgttacttatgaaaagtattttgcttaaggttgtgtgtgtattgtgtatatacctcaagttcaagttaatggcattgatttatgttccagacaaaaataacacaaataataatatccttcgttataaccacaatgagataagtattggcattagtgttcagtgccattttatactttctctctgtgttctctgtattgtactaaccaacctcccaaatcgctgagctgcttgtttaaaaaaaaaaaaaaggaaaaggaaaaagcatgacattgtgtatcgattttttgttgttgaccaaaatcacacacatggaaacatgtaattcaacagagtgggaaagctagcagattcttggcttagtattactaataggcaggattgtacaatgagcaactatcagattattcctttcagtggttcttatggcatctaaattactgaataaattattaatccattaatcagtgaatcaaattatgattacaattatcaaatgaatgctcagcattaattgaaaactgttttgtgaaacatgtctacccagaaaagtagcattctataaatactattaaacaacttagctatattatttttaagtattaaattatatgtcaagcagttaaagtgaatttcagagtaaaagtaaggcatgtttctgagcaacattgataatttcttaatttgcaaatttcttcttattttggtacttggaatatagtgtgagattttttatttctaaattttgttgtatcttctattacataaatgcattgacaattataaaatgcaagtgttttttgaatgattttaagaatttggcttaaaaattgattgatacaacgtattatttgtactaagaagtaacttgacccaaaacaccttttatgtttgcttagggtatattttttcagtgtctgaaagtcaaaggtattcctgtcacaactgtaaacaaacttatcctaaatgtgttaaaacatattcttgggtactctatttatgtatctttcatgccttgaaaatctgaaggttaatccaaactcacatgttttagcatatttgagaaaaaaaaactaccttcaatatcagccttttaaatttcatgaagattttggtgaggaataatagtatatagtttaagtattgacaaaactttgaaagtttctttctttaaaatgggaaatactcaatatctaaatccaggtcaggcatgggatatcagtatttaacattggatgttttatgttttatatttataatgttcaaaatgcaagcataacatttaatatttgtccacatggttttacaaaagtaaatcttaaattactaagcttttcccatatgttctcgtactttctcaaatccctataaagaattacttgttatctattaaaaatctcctttacccaaatctgtattatggtttcgccagacaaatattatgtgatgtagcccagaaaatccacaccttttgtcctttttatgttttaatttgaataatcatgtgcttagtcccttggattactgccacatcagtttaacacgatatcagcacattcccttgtcatcatcaaggtgttggctcagatttattcttaattggatgtttaaagcatgtactaccttgttacagttggtttagtgtagtggattattgacatgacatcatgagaagatgtgtaattttataccacatttataaaacatgattttgttttctacccttcaaggtaaacattaaaaataaggtggtacttgtgtacttgtacataaaaccaaaattatagttgggaaaaaaataaatttatatatgaaaatgtcaaaatcattttaaaagtattattttcaaataaaatggagaagctggtgaaaagtcatattggcaatttt

SEQ ID NO: 3553 - DNA, 445 bp, Homo sapiens
gccatccacatcctcgatgtccttgtgctgaatggcaccgacgttcgggagcagcactttaaccagcgaattcagcttgccgagaaatttgtgaaagccgtttccaagcctagtcggcccgacatgaatcccatcagggtgaaggaggtgtacagactggaagagatggagaagatttttgtcaggttggagatgaagatcatcaagggctccagtggcaccccaaagctcagctacacagggcgtgatgaccggcactttgtacccatgggcctctacatcgtcaggacagtgaatgagccctggactatgggattcagcaaaagcttcaagaagaagttcttctacaacaagaaaaccaaggactctacttttgacctcccttactaccctttcccttcctttttcttccctaataggaggtacaatctgcttttgtttgtcg

SEQ ID NO: 3554 - DNA, 545 bp, Homo sapiens
acatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgct

SEQ ID NO: 3555 - DNA, 5544 bp, Homo sapiens
atgcagctccgagcgagcgagcggcgcccagcccagcgcctcggccgaacccctccgcagcaggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtgagcattggcagcccagagaagatggagcccatcaccaaggtgtcacacattcccagcagccggtgggcgctagtgtgcagcctctgcaatgagaagtttggggcctctatacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggttcggaacctcacttacatggtgacccgcagggaaaagattaaacggtctgtgtgcaaagtccaggaacagatattcaatctttacactaagcttttggagcaagaaagagtttcaggtgtgccttcttcctgctcctcctcctcactggaaaacatgcttttgtttaacagtccttctgttggccctgatgctcccaagatagaggacttgaagtggcattctgcattcttcagaaaacaaatgggtacttccttggttcattcgctgaaaaagccccataagcgagatcctttgcagaatagccctggaagtgaaggcaaaaccctgctgaagcagccagacctgtgtggtagaagggaggggatggtggtcccagagagctttttgggtttagaaaagacctttgcagaagcacgtctcatatcagcacaacagaaaaatggtgtggtgatgccagaccatgggaaaagaagagacaatcgttttcattgtgatctcattaaaggagacttaaaggacaaatcttttaaacagagtcacaagcctctcaggtccacagatgtgtcccagaggcatctggacaacacaagagctgccacctcccctggagtggggcagtcagcacctggcacaaggaaggagatagtgcccaagtgcaatggctccctaatcaaagtaaactataatcagactgcagtcaaagtgcctacaacacctgccagcccagtgaaaaactggggaggattccggattccaaagaagggggaacggcagcagcagggagaggcccacgatggggcctgccaccagcactcagactacccatatttgggcttaggccgagttccagccaaggaaagggcaaaaagcaaattaaaatccgacaatgagaatgacgggtatgtccccgatgtggaaatgagtgactcagagagtgaggcatcagaaaagaaatgtatacacaccagcagcactatcagcagaaggacagacattatcaggagaagcatcttggcttcttgatgcaacagagatgatgcggaagccctttgggctcgtcattgggtttgctagaggagagctctgatgtgggggagaagcagaaacccattaatcctgagctacacaaacacatttacttgcaattcagattaatttttttccagagtcatttttaaatcatttttgtgagaagtttgtgttatttgcaacttgttgaggaaacagaagagtagattgtaaccataagacactgctaagactagaacccgaactgaacactaaaataaaaatgaaatgttttaaagaaggcaaggcttaaataagcctcatgaatttttatagccctctgcattcttcccaaagcacaaactcatggttacctgaatatagggaaccagatatggttcttgagaaaccctcatggtaccattcacagcccataaagtttattttctaggactgtggtagatcttgaaatcatatttatatttggccctcaaggctatttttgttgcattatagcatataggcagcagctctgaagcttcagtaacactaagaaatttatgtgtaaatatagcagtcagggaagagaattttaaaaaaggtcattattgaagaagctgaggggacagggtagagctgctgcaatatggagatttagggtaatatggcaaggtcctgctgcttgaagcctgtgagtgggttgtggatatgggactggtggagagtgagactgttaggaaagttgtatctatgaataagggcagttgaagtagaatttttaccagtccacttgaccttcttcttccctaaccactggctcttgagccagcttgggatttccctggccattgccaatacctggccatctggcttccaatagtacagtggctactcaagttcaagcgaagaacttccagactctggtgactgttacttcccagagccaaccactagtgcatatgttagggaatctgggcttccaacatgaatggattccttaagaaaaaggaaaaaaaaaaaaaaaagaaaaaaagaaaaaaaaaagaaaaaagaaaaaaagagaaaaaagcgaaataggttatattttaaaaacaatagaaaggcaataagttgcgataagctcttactattgaccaaggttatacaggaaagagactgaagtgtacccttgaataggttttctgtagtcagagttctaaactctaatttgtaacttggactttctaattgcaaatggcaataactattaagttatcagcaataataaatttagcattaaatttgagtacaatgttttgtttttgcactccccatagtgcgtatgtattaagacagtggatagtgtttaggtcctgttaattttctttggaattcaatgtggttgtgaatcaaacttaaggaaggaacgtttaaatagcaatgagatacagaattatgggcctttggaacaagcccgacttcccctaaattctccttagtttgttaataccagtattcagattcctgattcatttatacatctgtttccatatggcagggacattatgatacttaatgaataatgctttgaggagttctgcagttaactttcaagtcttccagatgattgtcaacaacaaaaaaggcttattgaatcccatcttgctatgcaagttttatcagatgatcaaatagtagatctgatacatccccattgtatgtacgacattttcaaaccaagtcttaacttttcaaggacattttagtagctaattcaggggagggggaagaatgatgcaggtttttagattgactgactatttttgagttatggggctcattttgaaagactgctgtccagatcagcttgttgctgcagataatagaaggttcttatgaatccaagttgtatattcacttgtaggataatttaaaaattagattttttttgcatatgagcaaaaaccttttgctggatacaggagaaggttggactttatctacagttatcttttgattacagcaacagctctgggtgagagtagaatttatagagggataatttgtcaagccatagaaagaaaatctaaattaatctagtaagtgtatgacctctcaccattttaagaggtatcagattcatttgcactattaggaatgctagttttgtgcaaaaataatgccttacctgttttttccccacatttaggttgaaaagctttcaaatgttccaagttatgctgaaccaaaaaaaacaaaacaaaaacaaaacaaaaaatattaaaaaaaacccacacaaaaacaaaacacacaaaaataaaaagcccacactttttattcctgcttcgaaatgcaaatggatagagcacggtttctctgacagtataatgatagctttgtgagttagtttcatgtcatgctgggaactctctatgaggtggccataagcagcaaccagcccaaacacccacttgcgttctattagtatggaaccatttgcatttgttttttttaagctttatctttccttgtgcatcctgaccaagaaatatctttgattatgattaatgtattatgtcaaaatgtaggctagttaaacttttgtaaagttgcctggaatgtcatttgttaggttataaacacaagatctaaatgaagggttttatgtgttgtgtacaaatcttattttgaaatggacaaacttgtcattacatttgtaaccttgtacagaggatttttcactatgtgcctagcttggtgtccattcagctaaaattgaaaaaaaaaaaaaggtgcatgaagagttaaaaatcaaattaaagtatatgtagagatgactattttatattacatgacccaatcctgtatttatttctaccccctttttgaaagtatttataaaactagttgaggacagctgtatttttttgttgaactatttagtagaattgtgcctttttgtctgtatgtgaataaatgctgtacattttgcaataca

SEQ ID NO: 3556 - DNA, 603 bp, Homo sapiens
gaaaccagacgtgcagtggggctgacccctgtgccccaccccagagtcatgccagcgtgggtggtggggcattctctgggatgaatgatctggatcccatagccatctgtgtcctgtttgaggaatgggaccctcaaacagagaacagccaagatgctcaagcagtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgagg

SEQ ID NO: 3557 - DNA, 442 bp, Homo sapiens
gtaggctgcgggcagcgaggagcggctggcgctcgaggcggcggacggcaccatgtccccggggagcggggtgaagagcgagtacatgaagcgctaccaggagccgcgctgggaggagtacgggccgtgctaccgcgagctgctgcactaccgcctaggccgccggctgctggagcaggcgcacgcgccctggctctgggacgactggggcccggccggctcctcggaggactcggcgtcgtcagagtcgtcgggcgccgggggccccgcaccccggtgcgccccgccctcgcccccgccgcccgtagagccggcgacccaggaggaggcggaacggcgggcgcgcggggccccggaggagcaggacgcggaggccggggacgcggaggccgaggacgcggaggacgcggctctgccagggaatgcctggctgcgcacctag

SEQ ID NO: 3558 - DNA, 740 bp, Homo sapiens; identical to SEQ ID NO: 1924

SEQ ID NO: 3559 - DNA, 816 bp, Homo sapiens
gcaaattatcgcatccctgagcttaggatccccctttagtttcacatatgcccccacccccgtttccactttgatggcggcttccaaggagcatcccttagtaagaaccgtcgcaaatatcgtgatttggatccaccaaggcttggggcgagccgtcgaatgtgtgtggtaggggagcgggctgatgttagcacgtggtcttgttaggccttgaatgggggaataggaggcctgtgttcacgattagtttccaccacctaccaacttggaacctttacatctctccaagcctgagtttccttatctgtgagacagctgcgaataccggtttccagagagtagttaagaacccttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagctggac

SEQ ID NO: 3560 - DNA, 2707 bp, Homo sapiens
acagccaggcagccccgcgtggggagtgcaggtggtttcggttgcggcagtcgcgtcccgggagcgtcgctgcctggtgaacgctgggtcgctcatctctgaaacccaggcgaaggagggctcgacgtcgcgggagtcctttcaacctgaccgcggcttacggtcttcggagctaatgttcattggtcccacaaaggggtcccacgtcgcgtccaggacatagaggccgtgaggcagggagccagaggtcgtctggactcttccgtactagtcagttttcgaactagagggggctttgggatcaccagtcggagcccttcgtgttacagctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcaggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgctatcttcactgagatttgccagcaggatgaagctagtcaccactgagcctgccatcaatgaaaagtatgatgctgagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgagccaacaggaacaggaagtggagtccactttgcgcaggaagtacaccctcattgacaggaatgactttgcagccatttctgctatccagaaggcggggcttgtggatgttgatggccacctagtgggtgagcctgaaggacaaaactttggactcggagtcgcccctttctctaccaaacctgggaagaaagccaagtccaagaagacattcaaagagccactcagctccttggcaagaaaggaaggtgccagcagccctgtgaatgggaaggacttggattacgtttccacctccaagacccagctggtcccatcctccaaagatggggatgtcaaagacatgctttcgcgggaccgggaaacttccagcattgagccccttccctcagactccccgaaggaggaattacgcccaattaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactacgggagaagcaaggcaagtacgaaaacaaggggctgatgatcatcgatgaggaagaattcctgctgatcctcaagctcaaagacctcaagaagcagtaccgcagcgagtaccaggacctgcgtgacctcagggctgagatccagtattgccagcacctagtggatcagtgtcgccaccgcctgctcatggaatttgacatctggtacaatgagtcctttgtcatccctgaggacatgcagatggcactgaagccaggcggcagcatccggccaggcatggtccctgtgaacaggattgtgtctctgggagaagatgaccaggacaaattcagccagctgcagcagagggtgcttcctgagggccctgattccatctccttctacaatgccaaagtcaagatagagcagaagcataattacttgaaaaccatgatgggcctccagcaggcacatagaaaatag

SEQ ID NO: 3561 - DNA, 1473 bp, Homo sapiens
accaccgctgcggccgccgcctccgccgctgctttcgctggagggcgggcggatgtacggggcgcctggggccccggcgcaaagcgcctcagtgactgtggtccgctcgttgcggcggccgccaccgcaggcgacaggggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgt

SEQ ID NO: 3562 - DNA, 1421 bp, Homo sapiens
aatcggctaggagcagcgagcggcgcggctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcaggtagtggcgtggcaatgtgcactccagggtggaagctcttctcatcctgctaactatctttcgtcactcacccccgcccagggcttccagatcctgtgtgacctgcacgatggcttctctggggtaggcgcgaaggcggcagagctgctacaagatgaatattcagggcggggaataataacttggggcctgctacctggtccctaccatcgtggggtgagtggaacttggaggagtaaacattcgaatcccattgggagagtggcttaatgcaaactggtttttttctttacgaggaggcccagagaaacatctatcgtctattaaacacagcttttggtctcgtgcacctgactgctcacagctctcgtctgccccttgtccttgggtgggagcctgggcctgcgacctgagccacctgtcaacttcccttacctgcattatgatgtaagtctcggtgctcttgttctgactgcggcaggctacagggcctcctcatgctcccagtcagtcgctgtctgtactggctctgttcctgaggcccgagcttgaactcagctgtgatgtggcctctcagatcacactgtcctatgcttgtccagcctggggtcaaacatacccctgattcatcccctgggtctctctggtgttaacattctgcctccacacattcttttccagg

SEQ ID NO: 3563 - DNA, 282 bp, Homo sapiens
tgcaccagctcctgcacgccctcgtgctgccagcagtctagctgccagccggcttgctgcacctcctccccctgccagcaggcctgctgcgtgcccgtctgctgcaagactgtctgctgcaagccttctagctgccagccagcttgctgcatctcctccccgtgtcaacagtcctgctgtgtgcccgtctgctgcaagcccatctgctgtgtgcctccagcttgctgcaccacctcctgctgcagaccctcctcctccgtgtccctcctctgccgccctgtg

SEQ ID NO: 3564 - DNA, 1513 bp, Homo sapiens
agctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagagcaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgag

SEQ ID NO: 3565 - DNA, 1103 bp, Homo sapiens; identical to SEQ ID NO: 3427

SEQ ID NO: 3566 - DNA, 887 bp, Homo sapiens
ccagggcaaccagaccgagaggagcatgtgtaacctgaaacaggtgagcctatggagacagtacctaatgcgactgtgcacggaatatgtgtatgcagcatgagctccagggaataaaactgcaaggtgtggaatatttctggcttctagtccaatgccaagtgtgtgacctgtggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaattggagctctggcagatcagcatatcattcatgtggcatgtggcgagtcccacagtctggccctcagtgaccgaggccagctgttttcttggggtgcagggagtgatggtcagctaggactcatgactactgaggattctgtggcagtgcccaggttaatacaaaagctgaaccagcaaacaatattacaagtttcctgtggcaactggcattgcttggctcttgcggctgatggccagttcttcacctggggaaagaacagccatgggcagcttggcttagggaaggagttcccctcccaagccagcccacagagggtgaggtccctggaggggatcccactggctcaggtggctgccggaggggctcacagctttgccctgtctctctcaggagctgtttttggctgggggatgaataatgccgggcagctagggctcagtgatgaaaa

SEQ ID NO: 3567 - DNA, 782 bp, Homo sapiens
tactttcccaagcaccaccaggccaaaggtctctcagttcagagcagaaagccgtatacccagaggagcaggcagataacagaaacttccagaaacctctgtggagacagtggaagaggcaaaagggagttcctgacagctggattctagaagtagaactatgagctcacctttggcctcccttagcaagacccgaaaagtgcccctgccctcggagcctatgaatcctgggaggcgaggaatccgcatctatggagatgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatg

SEQ ID NO: 3568 - DNA, 938 bp, Homo sapiens
gcggcggcggcagcggcagcggcagcggcgctgagttttgtctcccgggccgtctgggcgcgcgcgggtgtcccaggtaccccgccgcctccctccttcccgcaggactcgtccctcctggccctgggccccaacggtgcccgcctgcccggcggtcggtcagcgcacagggcacggcttcctctgcttctcccggaccacttagtctcaacccggaatgaaatatgactgaggactctcagagaaactttcgttcagtatattatgagaaagtggggtttcgtggagttgaagaaaagaaatcattagaaattctcctaaaagatgaccgtctgggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaat

SEQ ID NO: 3569 - DNA, 618 bp, Homo sapiens
gtacgggagctggaggctgagcttgatgcagagcagaagaagcacgccgaggcccttaagggcgtgcgcaagcatgagcgccgtgtcaaggagctcgcataccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaagctatccctttctcctcagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctcca

SEQ ID NO: 3570 - DNA, 591 bp, Homo sapiens
tgagtccctagtaggcctccaggagggcaaaagcaccgagcagggtaaccacgaccagcttaaagaactgtattcggctgggaacttgacggtgctggctactgaccccctgctccaccaggacccagtacagttagactttcacttccgccttacctcccagacctctgcccattggcacggccttctctgtgaccgtcgactcttcttggatatcccatatcaggccttggatcaaggcaaccgggaaagtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatc

SEQ ID NO: 3571 - DNA, 505 bp, Homo sapiens
agaattcagctgagagacagaggtcagacatgccagcagggttggaaagaggcaggtacggaagctgagctgcagagttagccggcatctgacagaaaaatgtgagtgtgctgtggaaggcttgcatttcctttaaggtagacctctttgaaagtagaattttcacggaattgttttctttctcactgagtgactgatttaacagaactctcaccttctatgcaagcgcacctagttttagagctccgtgacggcaatgttcaattagttcattattaactgagcaatgcagaatgctttatccagggtgcttggagaagatgtcagagtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatg

SEQ ID NO: 3572 - DNA, 796 bp, Homo sapiens
ggcggtgggggagtggctggggctgggggcggtatcggaccgggtgggcgcggtagagtgggcttggtgggttcccagggctggggttcgttccgggtgggctccgctttgggaagaggcccagcggaggggccttagtgtcagcgtagggagagtgaggcggcgaaggcgggggcgggcaaaggctagtggagtcgggatgcgagggcggtattcgtgacccggagctgtgcgaggagagtaccgaggagggggtcggcgggagaggagataggactcaagagtagccttcctcgaggacctgcctttcccatttgctgcctgaagttaatgtttcttgctggccaaatcagggacatgccggcattagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatca

SEQ ID NO: 3573 - DNA, 1519 bp, Homo sapiens
gatacagcagcagctggtgctcctggccaggctgtgcgtgctctctctgcctctctctctcggactctctgctctctctctctgactctctcctctctctctgttggcctggtgaaatgttcttggctgtaggcacacagagccttggactcaaggctgttggagtcgaggacaccttgacttcggtcctggaggttgaaattctgcctctgagaagctaacagtcttcctgtggtcgccactcctccccagcagccccctccttgccaaggacggtccagaaggagccccactggggcctccccgctcagcaaagcagacctcacctcccactaccagcttgaagtcacagcagccagaggaaattctgccaccattttcccaggtctgcagcccctccagctgggaacctgctcctggagccatccctctgcaaacagagagcccagagtgcctcggggaaaattggctgaataaaagagcgatcaggacgccacggctccgcctgaagcgatggcccagccctacccccccgcccagtacccccctccgccacagaacggcatccctgccgagtacgccccgcccccaccgcaccccacgcaggactactccggccagaccccggtccccacagagcatggcatgaccctgtacacaccagcacagacccaccccgagcagccaggctccgaggccagcacacagcccatcgccgggacccagacagtgccgcagacagacgaggcggcacagacggacagccagccgctccacccctccgaccctacagagaagcagcagcccaagcggctacacgtctccaacatccccttccggttcagggaccccgacttgcggcaaatgttcgggcaattcggaaaaattttagacgtggagatcatttttaacgagcggggctccaagggttttgggtttgtaacttttgaaactagctcagatgctgaccgagcccgggagaagctgaatgggacgatcgtagagggacggaaaattgaggtcaataatgccacggcccgagtgatgaccaacaagaagacggggaacccctacaccaacggctggaagctaaatccagtggtcggcgcagtctacgggcctgaattctatgcagtgacggggttcccctaccccaccaccggcacagccgttgcctaccggggcgcacatcttcggggccggggccgggccgtgtataatacatttcgggctgcgccacccccaccccccatcccgacttacggagcggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatgtgaaaccttccaccgtttccttctcggaccatgaagggcaaaaacaaaaaaacaaaaaaaatcacaaaac

SEQ ID NO: 3574 - DNA, 2821 bp, Homo sapiens
tcagcatcttgaacagtaatgaacaccttctgaaggaaaaagagcttctcattgacaagcagaggaaacacatctctcagctggagcagaaagtgcgagagagcgaactgcaagtccacagtgccctcttgggccgccctgccccctttggtgatgtctgcttgctgaggctacaggaattgcagcgagaaaacactttcttacgtgcacagtttgcacagaagacagaagccttgagcagagaaaagattgaccttgaaaagaaactctctgcttctgaagttgaagtccagctcatcagagagtcgctcaaagtggcgttgcagaagcattctgaggaagtgaagaaacaggaagaaagggtcaaaggtcgtgataaacatatcaataatttgaaaaagaaatgccagaaggaatcagagcagaaccgggagaagcagcagcgtattgagaccttggagcgctacctggctgacctgcccacactggaagaccatcagaagcagagccagcagcttaaggattctgagttgaagagcacagagctgcaggagaaagtgactgagctggagagtttgctggaggagacccaggcaatctgcagagagaaggagattcaactggaaagcctgaggcagagagaagcagaattctcctccgctggacatagcctgcaagataaacagtctgtggaggagaccagtggagaaggtccagaagtggaaatggagtcctggcagaagcgatacgattcgctccaaaagattgtggagaagcagcagcagaagatggatcagttgcgctcacaagtacagagcctagagcaggaagtggctcaagaagaaggaacaagccaggccctgagagaggaggcccagcgaagggattcagccctgcagcagctgcgcacagccgtgaaggagctttcagtgcaaaaccaggacttgattgagaagaatctgacactccaggaacacctgcgccaggcccaaccagggtctccaccttcaccagacacggcccagctggcacttgagctgcaccaggagttggccagttgccttcaagatctgcaggctgtctgtagcattgtgacccagagggcccagggccatgaccccaatctctccctgctcctgggcattcactcacagcacccagagactcagctagatttgcagaagccagatgtgatcaagaggaaactagaagaggttcaacagctgcgtcgtgacattgaggacttaaggaccaccatgtcagacagatatgcccaggacatgggagaaaactgtgtcacacagtgaggaattctgggggattcccccagggaggagctgggctgctgagagcctagtccagcaggtttctgccctgacattctcttgtctgctattcccagagaggtctcagaggggaggggagagcctgcatctgggggccaagggctgattagggaactgtgtcctacccacactggcatgttggattacgtttgtcctgttaattcactctagacggtgagttactaattaacttttggcaggtacaacagataagtcctcacaaactgttcccagccctaggctgacatgagagacgaacaggctgtccacctttcttctccatccaatgggatggatccatgttcattcccacttcacaccttggtcctgctgattagagagctcatcagaggggcctggaaaggctgagcaagtaccagtgacaatggccatttaagaattctcaggccccatgtgccagccttcttgggaactgagctggctttctgggttttctcatgcctggtcttactgcttcttcctcagggctcttgttctcccagaagcctcagggtaatgtgttggttagcacgtaactactaggattggggccctagggattatagccaggactctaatctgcctaccatgccatttaacaagagatcccactctccagctgccttgtgtccctagggtcctggccatgtgtttagtgtgctaaactttctcctttgttctcaggccttccaggtagtccccttcctggacttaagagtgcaaactcttctctgtggttctagccttgggcagaattatatcccagagaccacagagcaactgtcaagctgcttaccccctcacccagggctacagcctgtgcccagccctctaatttgtgcctctcttgtgttgggggtggtgggggttattcctttccctttcctgctctggcctccttgaaagttcagagtacccagtacaagtcagctttaaagtacagcttttagtgtttcctgggttgtttctctggggctttagtgagggacctttgccctctggtttttcttgcctcctggtttagggagcatctcacacttgttagtatctggttgttgggccagccgtgcctcctctagatctggagccaggccaggcaggggccacgtgtgggccagtcagccactacaagatttttgctaagctttgggctgttggcagcatcttggacctcatgcctgggcctgaatgaggctctttcttaagtgtttttacaagtttgtgttttatttatggagtgacttatcccttccattcagagcagccccacccagccagcccttcagcctctgggctcctgctgcttaaaggcagagccgcctggttggtctccaccctgtgcattgggagcccagccaccatgctgacgggtatttttcctcataaagtttataaccagttatttatatgaatctttgttatgtccatttgtttgtattgcgtattttgattataaaataaagtatcttaacaga

SEQ ID NO: 3575 - DNA, 673 bp, Homo sapiens
tttctgcgttcaatgtacatgtgttgagtcccagtttctgccgctttatctttcccgcctcccggcaggcaggccgttaaccgtcttccggaagacgctgctagaaccctccggccgctcctgcccgccatcgtccccgaacgacactcgctcagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacggaatttgagaatgggaacaggtcatggttctacttcagcgtccggggaggaatgccaggaaaactcatcaagatcaacattatgaacatgaacaagcagagcaagctgtattcccagggcatggccccctttgtgcgcacactgcccacccggccacgctgggaacgcattcgagaccggcccacctttgagatgacagagacgcagtttgtgttatcctttgttcatcgtttcgtggagggccgtggggccaccaccttcttcgccttctgctacc

SEQ ID NO: 3576 - DNA, 3318 bp, Homo sapiens; identical to SEQ ID NO: 2439

SEQ ID NO: 3577 - DNA, 6785 bp, Homo sapiens
ccgagccgggagccgagcgcgctgggcgcggccgtcccgctgccgccgccaagcccggagtgcgccagcggccatggttcccgcggcggcgccgggcgcctgagccccgggacgcaagcgctggaggcgggctgccggctgtgcgggcgctccggagagaccgacagaaggtgagcactgtgggctatgggatggatgaggtggagcaggaccagcatgaggcccgactcaaggagctgtttgacagttttgacacgacgggcacagggtccctggggcaggaggaactcaccgacctttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactggacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaagttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctcaatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagcagtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggggctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcagttggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacaggccttgctaccggagcagcgagcagtgcacgcagattcctacagaaggattgggcacctgtgaaaactgggctgctattgatggcatttcttaccatggcagacagatgcacacacccacccatgcacacacaccacacacagagacataagctaagatatgttggaattaagtgctcttttaaattattttattatttttactgttaaacctttgcagtattatgtctcttatttatttatgtagaaatgacagatcttgtgaatcaaattcacaaacatcagcttgttacaaatcattttatttataccctttaaagagtgtggatttaagattcttgaaaggatgtagtctatatattttctcattccatatgttgtaactatttttaaccaaaggtactacttttatatatggaatttgaagaaaaccaggggtatttatactgttttgtataagatgtacaaatctttttgacaggaaatttttgatgaaacaataaaataaattttaagt

SEQ ID NO: 3578 - DNA, 1218 bp, Homo sapiens
cgggcgccgcgggccatggcgggcgagaaccaccagtggcagggcagcatcctctacaacatgcttatgagcgcgaagcaaacgcgcgcggctcctgaggctccagagacgcggctggtggatcagtgctggggctgttcgtgcggcgatgagcccggggtgggcagagaggggctgctgggcgggcggaacgtggcgctcctgtaccgctgctgcttttgcggtaaagaccacccacggcagggcagcatcctctacagcatgctgacgagcgcaaagcaaacgtacgcggcaccgaaggcgcccgaggcgacgctgggtccgtgctggggctgttcgtgcggctctgatcccggggtgggcagagcggggcttccgggtgggcggcccgtggcactcctgtaccgctgctgcttttgtggtgaagaccacccgcggcagggcagcatcctctacagcttgctcactagctcaaagcaaacgcacgtggctccggcagcgcccgaggcacggccagggggcgcgtggtgggaccgctcctacttcgcgcagaggccagggggtaaagaggcgctaccaggcgggcgggccacggcgcttctgtaccgctgctgcttttgcggtgaagaccacccgcagcagggcagcaccctctactgcgtgcccacgagcacaaatcaagcgcaggcggctccggaggagcggccgagggccccctggtgggacacctcctctggtgcgctgcggccggtggcgctcaagagtccacaggtggtctgcgaggcagcctcagcgggcctgttgaagacgctgcgcttcgtcaagtacttgccctgcttccaggtgctgcccctggaccagcagctggtgctggtgcgcaactgctgggcgtccctgctcatgcttgagctggcccaggaccgcttgcagttcgagactgtggaagtctcggagcccagcatgctgcagaagatcctcaccaccaggcggcgggagaccgggggcaacgagccactgcccgtgcccacgctgcagcaccatttggcaccgccggcggaggccaggaaggtgccctccgcctcccaggtccaagccatcaagtgctttctttccaaatgctggagtctgaacatcagtaccaaggagtacgcctacctcaaggggaccgtgctctttaacccgggaaaagggaaggaaaatgattgcaatcatcattaa

SEQ ID NO: 3579 - DNA, 1079 bp, Homo sapiens
cggaccgggagcagcggccgcaggtccgggcgccatggctgcggagcggacccggccgctgcaaggctctggcggtccgagcgtgcctagtagctgtgaacccggcgcgaggtcccgggccccggggcgctcgctcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacagggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaata

SEQ ID NO: 3580 - DNA, 884 bp, Homo sapiens
aaaatgctcccgccgacgcacagcagtgacgacacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccgaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggtcacattcactaaatgtctatatgcacaattggtgcaacaaaggtttgtgccagaccggcggagtggatacaggc

SEQ ID NO: 3581 - DNA, 603 bp, Homo sapiens; identical to SEQ ID NO: 2833

SEQ ID NO: 3582 - DNA, 6784 bp, Homo sapiens
gtgggctcggcccgggctgccacgagcgtgcgggcctcgccgggcatgtcctaggcggcggccccgcccagcgctcggccgggcgggcgggcgggcgcgagggcagggaccgagccgggccgagctggggaacaagccggggaccaagccggggaccaagccggggactaaggcgagccggagaccgagcccgaacagcagggccagacgggcccagccagcaccaagatgagtgccacgtcctggttcctggtgagcagcagcggcgcccgccaccggctccctcgggagctcatcttcgtggggcgtgaggagtgtgagctcatgctacagtcccgcagcgtggacaagcagcatgccgtcatcaactacgaccaggacagggacgagcactgggtgaaggacctgggcagcctcaatgggacgtttgtgaatgacatgcgcatcccggaccagaagtacgtcacgctgaagctcaacgatgtcatccgcttcggctacgattccaacatgtatgtgctggagcgtgtgcagcaccgagtcccggaggaggcactcaagcatgaaaagtacaccagccagctgcaggtgagcgtgaagggtttggcgcccaagaggagcgaggcactgccggaacacacaccatactgcgaggcctcgaaccccaggccggagaagggggaccggagaccaggaacagaggcagcctcttaccgcacacccctgtatgggcagccctcctggtggggtgaggacgatggtagcacgctgcctgacgcccagcgccagggagagccctacccagcagagcgccccaagggaccagtgcagcaggacggggagctccacggcttccgcgcccctgctgagcctcagggctgctcgttccggcgggagcccagctacttcgagatccccacgaaggagaccccgcagccgtcgcagccccccgaggtgccggcacacgagatgcccacgaaggatgcagaggcaggtgggggcggagcggcccctgtggtgcagagccacgcctccttcaccatcgagtttgatgactgcagccctggcaagatgaagatcaaggaccatatcaccaagttttccctgcgccagcggcggcccccgggcaaggaggccacacctggcgagatggtgtcggctgagaccaaggtggccgactggctggtgcagaatgacccgagcctgctgcaccgggttggccctggggatgaccgccacagcaccaagagcgacctgcctgtccacacccgcaccctgaagggccacaagcacgaggacggcacgcagagtgactcagaggaccccctggccaaggcggcctcggccgctggggtgcccttggaggccagcggggagcaggtgcggctgcagaggcagatcaagcgggacccccaggagctactacataaccagcaggcctttgtcatcgagttcttcgacgaggacacaccccgaaagaagcgctcccagtccttcacgcacagcccgtccggggaccccaaggccgacaagcgccgtggcccaacgccggccgatagggaccgccccagtgtcccagccccagtccaggcagggggccgcagctcggggccacagagggccggctcgctcaagcgggagaagacagaggaacggctgggcagcccctcgcccgcctcccgaacccctgcccgccccttcggaagcgtggggcgccgctcccgcctggcccaggacttcatggcccagtgtctgcgggagagctccccggccgcccggcccagccccgagaaggttcctccggtgctgcccgctcccctgacaccccatgggaccagccccgtgggccccccgaccccaccgcccgcccccacggacccccagctgaccaaggcacggaaacaggaggaggacgacagcctcagtgacgcagggacatacaccatcgagaccgaggcgcaggacacggaggtggaggaggcccggaagatgatcgaccaggtctttggggtgttggagtcccctgaactctccagggcatcttcggccacctttcgcccagtcatcagaggggacagagatgagtctgatgacgggggcgtggcccagcggatggcgctactgcaggagtttgcctcccggccactgggtgcggccccccaggcggagcaccagggcctcccggtgccgggctcccctgggggtcagaagtgggtgtcccgctgggccagcctggctgacagctactcagacccgggcctcacagaggatggcctgggacgtagaggcggggagccggaggggtccctgcctgtgcgcatgcggcgacggctccctcagctgcccagtgagagggctgacagccctgcgggcccagagagcagcaggaggagtgggcctgggccaccggagctggacagtgagcagcccagccgcctcttcggccaggaggagttggatcctgacagcctcagcgatgccagtgggtcggacgggggccgaggccccgagccaggggtggagccacaggacagcagacgcaggagcccccaggaggggcccacgtggagcaggggtcggcgctcaccaagggcccccggggagccaactcccgcctctttcttcattggggaccagaatggggacgctgtgttatctaggaaaccgcttgcggctccaggggatggggagggcctagggcagacagcccagcccagccccccagcacgggatggcgtctatgtcagtgccaatgggagaatggtcatccagctacggcctggacggtccccagaacccgacggccctgccccagcctttctccggcaagagagcttcactaaggagccagccagtggtcccccagcgcccggcaagcccccccacatctccagccacccgcttctacaggacctggccgctacccgggccgcacgcatggacttccactcccaggacacccacctgatcttgaaggagacggagacggccctggcggccctggaggcccgactcctctctaattctgtggatgccgagtgtgaggggggcagcaccccgaggccgccggaggacgccctgtctggggactcggacgtggacacagccagcaccgtcagcctgcgtagtggcaagagcgggcccagccccacaaccccccagcctctgcgggcacagaaggagatgtcgccatccccgccagctgcacaggacccgggaggcaccgccctggtcagtgcccgtgagcagtcctcagagaggcagcatcacccacttggcccgacggacatgggccgtggagagccggtacggcgctcagccataaggcgtggccacaggccccgagggtccctggattggcccagtgaggagcgtggccctgtcctcgcccacctacccagctcagatgtgatggcctccaaccacgaaacccctgaggccaccggggcaggacggctaggttctcgccggaaaccagcggccccaccgccatccccagctgcccgggaggagcagagccgtagctcagccagctcccagaaggggccgcaggccttgacccgctccaacagcctgtccacccctcgccccacacgggcctcccggctgaggcgggcccggctgggggacgcttcagacactgaggctgcggatggtgagcgggggtccctgggcaaccctgagcccgtgggccggccagctgctgagcaggccaagaagctgtcacgcctggacatcctggccatgccccggaagcgggccggctccttcacagggactagtgaccccgaggcagcccctgcccgcaccagcttctctggccgcagtgtggagttgtgctgtgccagccgcaagcccaccatggccgaagcacgggctgtctccaggaaggctgccaacacagccaccaccacgggtccccgccagcccttcagcagggcccgctcaggcagtgcccgatacacctccaacacgaggcgccggcagcagggctcggattacacgtccacctctgaggaggagtacggctcccgccacggctcccccaaacacacacgctcccacacctcaacagccactcagaccccgagggctggcagctccagccgggctcgttcccgggcccccggcccccgggacacggacgacgatgaggaggagcctgacccttatggtttcatcgtgcagacggcagagattgcggagattgccaggctgagccagacgctggtgaaggacgtggccatcctagcccaggagatccacgatgtggctggggacggtgacacactgggctcctcggagcctgcccacagcgcctccctcagcaacatgcccagcacccccgcctcgaccatctctgcccgggaggagctggtgcagcgcatccccgaggccagcctcaacttccagaaggtgccgcccggctcgctgaactctcgggactttgaccagaacatgaacgacagctgtgaggacgccctggccaacaagacgcggcctcggaaccgagaggaggtgatcttcgataacctgatgctgaacccggtgtcccagctgtcgcaggccatccgtgagaacacagagcaccttgccgagaagatgaagatcctctttcagaacacagggagagcttgggaggacctggaagccaggatcaacgccgagaacgaggtgcccatcctgaagacatctaacaaggaaatcagctccatcctgaaggaactgaggcgggtgcagaaacagctggaagttatcaatgccatcgtggaccccagtgggagcctggacctgctcacaggaaacaggagcttggccagctctgcacagccggggctggggaagggccgcgtggctgcccagagcccaccctcacccgcctcagccgaggccctgctgccagccctgcccctgaggaatttcccacagcgggccagctgtgggcctcccagcctcccggaccccaccttcctccctgatgccgagaggttcctgatctaggccccagacctggccaggccagcctccctgtgcgtgtgcgtctctgccttccgtccgccgcacacccgcctgcctggccgcaggtggttctccctgaagacccccacatgtgccatatccctgtgggcgggtgcctcccacgcccttgccccctcgtcagctcccagccagcaccctactcaccctgtccagccccatggccacccccacccctgcctcgccccctacaggcctctgggcccagctcctggccaggctgctgccaaggtcaagccctcaagggcattaccccgcctcctcttcatcactgttatttttgtctttagctttaaaggaaagagttgttggtgccattgcaggtgccccctccaggcctgactggctccgccaggcactaacctgccataaccctttgtgctggcctgcggccaggcagaggaagagaggtcgactgtggggtcatttggtgccaaacatggaggtgggcaggctcacctgttcctgggactgtctgagatggcagggcacttgccctggtggctcccacctgaccccaggccttttataggcaggagccccactgcttccagcctctggtgccaacacagttgccaaacccattgagcttggggctgccctgtggaggcctcctgggtatggaccaggggcttgttgagagctgagccatgcacacaggtgcagacaccccccaactcccatgcacacggctagtccaggcgcctccacgctgcaccgtgaggactgcagggcatgtccccgtgaggggctatgggcctctgtaggtgggcttccaaggtcctgggtgcagccgggtgcatggcagcccttctggcgggggtgagcgcacgaccaaagtcactggaagccgggtttccggaagctcgcagcttggcctgcaccacacgccctccccttttggcttcacgccatcaggcctcaagtgggcatgggggcagggacgggcccaggaactgttgttttctcaggattctttcagctgggaacatggcaggtgagcagagcttggtgcctctgccgtggcccctgctggggcagcccgtgttgccggagcctctaagccaaagagcccgttggccgtggttggtgggggtggacgtgggggtgtcccacctggaccagactggcgtgggtgagctccacaccctgcctggcaatggtatgagagtcggacctggacagggccagctgctgggggagcggcactggggactggaggctggaagcgggtggtgtgtgtcccctgtttacttttagctgagctggggttgggtgtacgggttctgttcctctgagcctgcggcccacctgatgtttacgtgtgtgtgtgagggggggcgggggtggcaggtgtccccccctggtccccgccccaagagcctgctgtctgtatggaggaggtgctagcccggtccaccgggctgctgcccacccctgcatgccccagttgcccaccccgcctgcccctggacatgaagtggtcacgcttcatccacggctccttcccacccctcggcagtggctgtgcaatgttttaagttcacaagttcctgctcctccccacactgagctcctttgttcctccccctccagcctttgcctgggaactggtccttgtttgccgggcttctcggagggttcactgtacattcgttctcaggtggtcttgtggctgtctttcggaaaatggttattttatatgatttgtcatggaatttgttctaataaatcattcttctatcac

SEQ ID NO: 3583 - DNA, 1897 bp, Homo sapiens
tcccggcgtgccccgcggcgggcgctgggccggagccggagcccaagccagagcggcgcggcctggaagaggccagggcccgggggaggcggcggcagcggcggcggctggggcagcccgggcagcccgagccccgcagcctgggcctgtgctcggcgccatgagcggcggcgggccttcgggaggcggccctgggggctcgggcagggcgcggactagctcgttcgcggagcccggcggcggaggcggaggaggcggcggcggccccggaggctcggcctccggcccaggcggcaccggcggcggaaaggcatctgtcggggccatgggtgggggcgtcggggcctcgagctccgggggtggacccggcggcagcggcggaggaggcagcggaggccccggcgcaggcactagcttcccgccgcccggggtgaagctgggccgtgacagcgggaaggtgaccacagtcgtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaaggtgtacatgtaccagctcttccgcagcttggcctacatccactcccagggcgtgtgtcaccgcgacatcaagccccagaacctgctggtggaccctgacactgctgtcctcaagctctgcgattttggcagtgcaaagcagttggtccgaggggagcccaatgtctcctacatctgttctcgctactaccgggccccagagctcatctttggagccactgattacacctcatccatcgatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtgaactctccatccaaccgtctctcaacgccattcttatccctcctcacttgaggtccccagcgggcactaccaccctcaccccgtcctcacaagctttaactgagactccgaccagctcagactggcagtcgaccgatgccacacctaccctcactaactcctcctgagggccccaccaagcacccttccacttccatctgggagccccaagaggggctgggaaggggggccatagcccatcaagctcctgccctggctgggcccctagactagagggcagagaaaacgtcgattcgcaccgtccaacctggccccgcccctcctacagctgtaactcccctcctgtcctctgcccccaaggtctactccctcctcaccccaccctggagggccaggggagtggagagagctcctgatgtcttagtttccacagtaaggtttgcctgtgtaca

SEQ ID NO: 3584 - DNA, 2589 bp, Homo sapiens
ctgagctgagtgacaggaagacggttcaatgggcggcgcggaggcggagccgtgggggcgggctcccggtcccgctatcggcggccggcgggcaggcgactcctgtcccgggtggaggcggcggagccggagccgggggagggggcagcggctgtctcacggaccacggcggcgcccgcagctcctcaccgcagcacccccactgcaggcccgaggagctttccggagcttcccacactcctggggagaagacttcttagccagcttgatgtttaaaattcagctggagcccttaaaacttcgagcgtggacgctgaatgggtttgtaaagtttcgaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaatatgg

SEQ ID NO: 3585 - DNA, 503 bp, Homo sapiens
gtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgagaagctcccctctggctctagttggagaatcccaacccaagcaagtccatccttaaacaataaacatctccagcattgctggctttggaagaccccatggtgagatgctggagcttttttccgctccagatttcgcttctaaatatttacttttactttccatgttcacttataggccagggtttttttttcctaccattgaattatttcgtcatgttctatttaattattgctttaattggcattggtgaccacaaataataataaatactattaactg

SEQ ID NO: 3586 - DNA, 818 bp, Homo sapiens
gggtctgggcagggctgggcagtgctgccggagcaaaagcggtagcgggagcccggccggagctgggtctggagacgccgtggcagcctgaacggagtgtgcgacggattgggaggaggaactgccaggtcggatgtggagatgaacccggagagtgtccttcggctctggtcggccttcaggggcattcctgccagtctcagaagatgacagtctgcaatcgtgttatcatcaacgtggaaaaaataagggcaatgcagttttcatgtgtgtaaggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagctcgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtacatctgtcc

SEQ ID NO: 3587 - DNA, 1476 bp, Homo sapiens
gaaagagcagaagaggaggtggggtggagggagcagagccagggattaggggactactgaggctctggagatgagaccgccaggagtccttccccaccatgagccccctccactcctgcagctggaggagtttttcccagtctcagtgctgccctggggcgagagagactgaacaagctgtttgggtgggaagagaatggaggaagttgacagggatgggcggggcccgtgggggggctgaccaggaacccagcttcctgctcagtacccaggcatccagcccccagctcacccccaccccttccagcccccactcccctcaggaacccaaggttccagccctcctcccaaatcccagccacccctcccccaccagtttctcccctctaggggatggaggctgagagaccccaggaagaagaggatggtgagcagggcccccctcaggatgaggaaggctggccccctccaaactccaccactcggccttggcgatctgctcctccgtcccctcctcctccagggacccgccacacagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctgga

SEQ ID NO: 3588 - DNA, 998 bp, Homo sapiens
gcaccgctgagctgccgagaggaagctcgctctgcccggctgccctcttgtagtccgccggcgaggggcagttctcggtgaggaggaagagagcagcggacggcacagcacccgcgcgggccctccggcaggcggcttctcagagttttcaggtggcgaaactgactggtctggttagagcgcgtccaagccaagccgcagtgctgtttggatttttaaatttctccttctgagtgagaaaatagcaatcgagatggaaccatccgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggccaa

SEQ ID NO: 3589 - DNA, 558 bp, Homo sapiens
aaaaccgcatccccgcaggaggctcggccgccgcgcgcccgcggccctccgtcccgccccggccggctggcggtcacctggcacaccagcgcccgcaggatgcccagaaacagagcctcactctgtcacctaggctggagtgcagtggtgcaattatggctcactgcagtttcaacctcccagattccagtcatcctcctgcctcagccacccaagaagctgggaccacaggtactgcttaggatgaatatgatttggagaaattccatttcttgtctaaggctaggaaaggtgccacacagataccaaagtggttaccacccagtggcccctctgggatcaaggattttaactgacccagccaaagtttttgaacacaacatgtgggatcacatgcagtggtctaaggaagaagaagcagcagccagaaaaaaagtaaaagaaaactcagctgtgcgagtccttctggaagagcaagttaagtatgagagagaagctagtaaatactgggacacattttacaagattcataagaataagtttttcaaggatcgtaat

SEQ ID NO: 3590 - DNA, 361 bp, Homo sapiens
ggaaggagagtctccaacggcatcaccccactcatctgccaccgatgacctccaccattcagacagataccagacctttctgcgagtacgagccaaccggcagacccgactgaatgctcggattgggaaaatgaaacggaggaagcaagatgaagggcaggtatgtcccctgtgcaaccgccccctggcaggatcggagcaggagatgagtaggcatgtggagcattgcctttctaagagggaaggctcctgcatggctgaggatgatgctgtggacatcgagcatgagaacaacaaccgctttgaggagtatgagtggtgtggacagaagcggatacgggccaccactctcctggaaggt

SEQ ID NO: 3591 - DNA, 3010 bp, Homo sapiens
actgctccttctctcacgccaactgagtctcttgatctgtacatgcaatcccaggcagctcgcgaacacaaacccggggccagccgcctactgctgctgctgctgctgccgctgccgccgccgccgccgccgctgcctccgccggctctgcgaacccgggacttttcatgcaccacactctccgcctgcttccctccgtgtcctgaaaagtgcgaccgttctcccaaggaatttccacggcaagtcttaggagggaatgattccccagtaatattccctgccctgacccaaagtgctggttggcctccctcccagggaagactgcttcttgcgtaacgccggccacagaaagagactccgatggacttacaccgggcagccttcaagatggagaactcatcctaccttcccaaccctctggcatccccagcactgatggtcctggcatccacggctgaggccagccgtgatgcttccatcccttgtcagcagccacgaccctttggtgtacctgtctcagttgacaaggacgtgcatattcctttcaccaacggttcctatacctttgcctctatgtaccatcggcaaggtggggtgccaggcacttttgccaatcgtgatttccccccttctctactacacctccaccctcaatttgctcccccaaatctagattgcaccccaatcagtatgctgaatcatagtggtgtgggggctttccggccctttgcctccaccgaggaccgggagagctatcagtcagcctttacgccggccaagcgacttaagaactgccatgacacagagtctccccacttgcgcttctcagatgcagatggcaaggaatatgactttgggacacagctgccatctagctcccccggttcactaaaggttgatgacactgggaagaagatttttgctgtctctggcctcatttctgatcgggaagcctcatctagcccagaggatcggaatgacagatgtaagaagaaagcagcggcattgttcgacagccaggccccaatttgccccatctgccaggtcctgctgaggcccagtgagctgcaggagcatatggagcaggaactggagcagctagcccaactgccctcgagcaagaattcccttctgaaggatgccatggctccaggcaccccaaagtccctcctgttgtctgcttccatcaagagggaaggagagtctccaacggcatcaccccactcatctgccaccgatgacctccaccattcagacagataccagacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagttg

SEQ ID NO: 3592 - DNA, 5169 bp, Homo sapiens
gcgcatcaggcgctgttgttggagccggaacaccgtgcgactctgaccgaaccggccccctcctcgcgcacacactcgccgagccgcgcgcgcccctccgccgtgacagtggccgtggcctccgctctctcggggcacccggcagccagagcgcagcgagagcgggcggtcgccagggtcccctccccagccagtcccaggcgcccggtgcactatgcggggcacgtgcgccccccagctctaatctgcgcgctgacaggagcatgatctgtgcccaggccagggctgccaaggaattgatgcgcgtacacgtggtgggtcattatgctgctgcacctgtgtagtgtgaagaatctgtaccagaacaggtttttaggcctggccgccatggcgtctccttctagaaactcccagagccgacgccggtgcaaggagccgctccgatacagctacaaccccgaccagttccacaacatggacctcaggggcggcccccacgatggcgtcaccattccccgctccaccagcgacactgacctggtcacctcggacagccgctccacgctcatggtcagcagctcctactattccatcgggcactctcaggacctggtcatccactgggacataaaggaggaagtggacgctggggactggattggcatgtacctcattgatgaggtcttgtccgaaaactttctggactataaaaaccgtggagtcaatggttctcatcggggccagatcatctggaagatcgatgccagctcgtactttgtggaacctgaaactaagatctgcttcaaatactaccatggagtgagtggggccctgcgagcaaccacccccagtgtcacggtcaaaaactcggcagctcctatttttaaaagcattggtgctgatgagaccgtccaaggacaaggaagtcggaggctgatcagcttctctctctcagatttccaagccatggggttgaagaaagggatgtttttcaacccagacccttatctgaagatttccattcagcctgggaaacacagcatcttccccgccctccctcaccatggacaggagaggagatccaagatcataggcaacaccgtgaaccccatctggcaggccgagcaattcagttttgtgtccttgcccactgacgtgctggaaattgaggtgaaggacaagtttgccaagagccgccccatcatcaagcgcttcttgggaaagctgtcgatgcccgttcaaagactcctggagagacacgccataggggatagggtggtcagctacacacttggccgcaggcttccaacagatcatgtgagtggacagctgcaattccgatttgagatcacttcctccatccacccagatgatgaggagatttccctgagtaccgagcctgagtcagcccaaattcaggacagccccatgaacaacctgatggaaagcggcagtggggaacctcggtctgaggcaccagagtcctctgagagctggaagccagagcagctgggtgagggcagtgtccccgatggtccagggaaccaaagcatagagctttccagaccagctgaggaagcagcagtcatcacggaggcaggagaccagggcatggtctctgtgggacctgaaggggctggggagctcctggcccaggtgcaaaaggacatccagcctgcccccagtgcagaagagctggccgagcagctggacctgggtgaggaggcatcagcactgctgctggaagacggtgaagccccagccagcaccaaggaggagcccttggaggaggaagcaacgacccagagccgggctggaagggaagaagaggagaaggagcaggaggaggagggagatgtgtctaccctggagcagggagagggcaggctgcagctgcgggcctcggtgaagagaaaaagcaggccctgctccttgcctgtgtccgagctggagacggtgatcgcgtcagcctgcggggaccccgagaccccgcggacacactacatccgcatccacaccctgctgcacagcatgccctccgcccagggcggcagcgcggcagaggaggaggacggcgcggaggaggagtccaccctcaaggactcctcggagaaggatgggctcagcgaggtggacacggtggccgctgacccgtctgccctggaagaggacagagaagagcccgagggggctactccaggcacggcgcaccctggccactccgggggccacttccccagcctggccaatggcgcggcccaggatggcgacacgcaccccagcaccgggagcgagagcgactccagccccaggcaaggcggggaccacagttgcgagggctgtgacgcgtcctgctgcagcccctcgtgctacagctcctcgtgctacagcacgtcctgctacagcagctcgtgctacagcgcctcgtgctacagcccctcctgctacaacggcaacaggttcgccagccacacgcgcttctcctccgtggacagcgccaagatctccgagagcacggtcttctcctcgcaagacgacgaggaggaggagaacagcgcgttcgagtcggtacccgactccatgcagagccctgagctggacccggagtccacgaacggcgctgggccgtggcaagacgagctggccgcccctagcgggcacgtggaaagaagcccggaaggtctggaatcccccgtggcaggtccaagcaatcggagagaagactgggaagctcgaattgacagccacgggcgggtcttttatgtggaccacgtgaaccgcacaaccacctggcagcgtccgacggcagcagccaccccggatggcatgcggagatcggggtccatccagcagatggagcaactcaacaggcggtatcaaaacattcagcgaaccattgcaacagagaggtccgaagaagattctggcagccaaagctgcgagcaagccccagcaggaggaggcggaggtggagggagtgactcagaagccgaatcttcccagtccagcttagatctaaggagagaagggtcactttctccagtgaactcacaaaaaatcaccttgctgctgcagtccccagcggtcaagttcatcaccaaccccgagttcttcactgtgctacatgccaattatagtgcctaccgagtcttcaccagtagcacctgcttaaagcacatgattctgaaagtccgacgggatgctcgcaattttgaacgctaccagcacaaccgggacttggtgaatttcatcaacatgttcgcagacactcggctggaactgccccggggctgggagatcaaaacggaccagcagggaaagtcttttttcgtggaccacaacagtcgagctaccactttcattgacccccgaatccctcttcagaacggtcgtcttcccaatcatctaactcaccgacagcacctccagaggctccgaagttacagcgctggagaggcctcagaagtttctagaaacagaggagcctctttactggccaggccaggacacagcttagtagctgctattcgaagccaacatcaacatgagtcattgccactggcatataatgacaagattgtggcatttcttcgccagccaaacatttttgaaatgctgcaagagcgtcagccaagcttagcaagaaaccacacactcagggagaaaatccattacattcggactgagggtaatcacgggcttgagaagttgtcctgtgatgcggatctggtcattttgctgagtctctttgaagaagagattatgtcctacgtccccctgcaggctgccttccaccctgggtatagcttctctccccgatgttcaccctgttcttcacctcagaactccccaggtttacagagagccagtgcaagagccccttccccctaccgaagagactttgaggccaagctccgcaatttctacagaaaactggaagccaaaggatttggtcagggtccggggaaaattaagctcattattcgccgggatcatttgttggagggaaccttcaatcaggtgatggcctattcgcggaaagagctccagcgaaacaagctctacgtcacctttgttggagaggagggcctggactacagtggcccctcgcgggagttcttcttccttctgtctcaggagctcttcaacccttactatggactctttgagtactcggcaaatgatacttacacggtgcagatcagccccatgtccgcatttgtagaaaaccatcttgagtggttcaggtttagcggtcgcatcctgggtctggctctgatccatcagtaccttcttgacgctttcttcacgaggcccttctacaaggcactcctgagactgccctgtgatttgagtgacctggaatatttggatgaggaattccaccagagtttgcagtggatgaaggacaacaacatcacagacatcttagacctcactttcactgttaatgaagaggtttttggacaggtcacggaaagggagttgaagtctggaggagccaacacacaggtgacggagaaaaacaagaaggagtacatcgagcgcatggtgaagtggcgggtggagcgcggcgtggtacagcagaccgaggcgctggtgcgcggcttctacgaggttgtagactcgaggctggtgtccgtgtttgatgccagggagctggagctggtgatagctggcaccgcggaaatcgacctaaatgactggcggaataacactgagtaccggggaggttaccacgatgggcatcttgtgatccgctggttctgggctgcggtggagcgcttcaataatgagcagaggctgagattactgcagtttgtcacgggaacatccagcgtgccctacgaaggcttcgcagccctccgtgggagcaatgggcttcggcgcttctgcatagagaaatgggggaaaattacttctctccccagggcacacacatgcttcaaccgactggatcttccaccgtatccctcgtactccatgttgtatgaaaagctgttaacagcagtagaggaaaccagcacctttggacttgagtgaggacatggaacctcgcctgacattttcctggccagtgacatcacccttcctgggatgatccccttttccctttcccttaatcaactctcctttgattttggtattccatgatttttattttcaaac

SEQ ID NO: 3593 - DNA, 1945 bp, Homo sapiens
atggatttaaaggggcagtaccggcaagagcggcagccacaccggcagattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgagg

SEQ ID NO: 3594 - DNA, 1721 bp, Homo sapiens
gccctcgcgctgtcgccgccacagtctgcgacgggacccggcgtgcccatgtgtcaggtgggcgaggactacggggagccggcgcctgaggagccgcccccggcgccgcggcccagccgtgagcagaagtgtgtgaagtgcaaggaagcgcagcccgttgtggtgatacgagccggagatgccttctgcagggactgtttcaaggccttctacgtccacaagttcagagccatgctgggcaagaaccggctcatctttccaggcgagaaggtgctcttggcgtggtctggggggccttcgtccagctccatggtctggcaggttcttgagggcctgagccaagattctgccaaaagactgcgctttgtggcaggagtcatctttgttgacgagggagcagcctgtggccagagcctagaggagagatcaaagaccctggccgaagtgaagcccattctgcaagcaactgggttcccatggcatgtggtggccttagaggaggtgttcagcctgccaccgtcggtgctttggtgctctgcccaggagctggtgggatccgagggggcctacaaggcggccgtggacagcttcctccagcagcagcatgtgctgggggccgggggtggtcctggcccgactcaaggggaggaacagccaccccagcccccgctggacccccagaacctggcaagaccgcctgcccctgcccagactgaggctctttcccaactgttctgctcagtgaggacactgactgccaaggaggagcttctgcagaccctgcggacccacctgatcctccacatggcccgagcccacggctactccaaggtcatgactggggacagctgcacacgcttggctatcaagctcatgaccaacctggcgctgggtcgaggggccttcctggcctgggatacgggcttctcggatgagcggcacggggacgtggtggtggtgcggcccatgcgggaccacaccctgaaggaggtcgctttctacaaccgcctgttctccgttccttctgtcttcacaccagccgtcgacaccaaggcccctgaaaaggccagcatccaccggctgatggaggccttcatcctcaggctgcagacccagttcccctccactgtcagcactgtgtacaggacaagtgagaagctggtgaagggcccccgggatggccctgctgctggcgactccggcccccgctgcctcctctgcatgtgtgccctggacgtcgacgccgctgacagtgccacggcttttggggctcagacctcctcgcgtctctcccagatgcagtcacccatccccctgactgagacccggacacccccggggccctgctgttctccaggggtgggctgggcccagcgctgtggccagggggcctgcaggagggaggacccccaagcctgcattgaggagcagctgtgctacagctgccgcgtgaacatgaaggacttgccctcactggaccccctgccgccgtacatcctggctgaggcccagctccgcacacagagggcctggggcttgcaggagatccgggactgtctgattgaggacagtgacgacgaggcgggccagagctgagcgtgaggacgtgcttgccgggacagcaggcagtggccacctggtacaccacactggagccggaaggcaaggacgggggactggcctctgattgtccatttgtataaataaaacattttttaatt

SEQ ID NO: 3595 - DNA, 2818 bp, Homo sapiens
cattgagtaggttcttggggattggggtcgggtcctccccagtgagaggcgacaggagctcactgcctctcgggccctcacaatcacacctgtcacaggtatacacgctgccactcacaaacacacgcttgcactcccagcctcactgacacgctgccatacagccgctcacagccagccagacactgctgcacctgagagcaggtggccgcgggtcttctcccttcactctccacatttggggatcaggtccggcacctgctgcgccagacaggccttgctgggcacgcgcctctgagagtccaaggaggtggcttccagagctgcagcacttcaggccggctccggtggagcgatcagaggtgaggggcttggctgggcatgtttaagcgcacagtgctctcctgcccacccccagcagcacccccactgcaggcccgaggagctttccggagcttcccacactcctggggagaagacttcttagccagcttgatgtttaaaattcagctggagcccttaaaacttcgagcgtggacgctgaatgggtttgtaaagtttcgaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaatatggca

SEQ ID NO: 3596 - DNA, 9444 bp, Homo sapiens
gtgctgtggcggcggcggcggcggtagtggcggcggcggcggtgcctgggcggcagcagcagcagtagcggcagccctgaggacggtgagacggccgcggcggcggcgacagcgcggaagtcgcgcgggacccagagcttcccccctgtcgctagtgctgaggctttcgcctttcctacccagcttcttgctcacggcccgggctgggctgggcagggcaacgcgcccccggggaggggcggagctgtagatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagccttttttctaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccaggatgaggaggagggtatatgggcatagccaatcagaggcttagttcagccattttgttcagaacgatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtcactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcaggaggcaggagaatcgcttgagcctgggaggcagaggctgcggtgagccgagatcgtgtcactgcactccagcctgggtgacagagactccatttaaaaaaaaaaaaaaaaaatatatatatatatatatatatatatatatggatgggaatcaccaaattcatctcagctctaaccttttaacctttgtccttgcactttacaatctaaagatctacctgtggctctcagacttcctcacacttgggttttagaaataacttgtaaagcagactggacccaaggccgccttcagtgtcaagaagggcattgtgacttgcccctcaatttctgtccattgaagtctggttttccatgaggaacttgcgggctcacccacccccagagtgagagaagaggaaggcgaagtcatcacagacacggtcttagccacctgctgaactaatccctccgctattgagggtcagggttgtgaggcaaccatcatgtgtcaccccaaaatataaatgtttctgagccgcccatccactggcatttggatttgctgccagagtcctgttcctcccagaaccatcccgccctcctgttgaccatgttacttgagtgtaggcccggtgtcaagaccctcagagtctttgaggaaagagccaagcagagaagaccgctgcgtggagtgtgacaccacatggcatttctcaagcccagcggaccctgtgtcagcaaataccagtaatttaacatctgctcctggcctcctcttcacctgcctgggttcggaactgaggaggaaggatgagaagagactgcaatgcagcaggcaccctctgcagagtgaggccgcccgtccatcactgccagccctgggctgctcaggaggggacgtgaaccactcaaaggaatgtcttaaagaggatctggagtttcccccatgcaaattagggaagaattaggcaagaaaagacatacattacagggaaatccttctgaacaaaatggctgtcttcacctactcttcttgcaagaaaagacatacattacagggaaatccttctgaacaaaatggctatcttcacctactcttcagcaaaaaccgtctccagactttttagtgtcaaaaatgtaaccaactgtctcctgattttttccaatgtgtttggcaagtgctgtggccctgttgtaggtacttctcctgactcttgggggagaagtggttttagggattgatttgggggagcgggtttttgtcccatcccacctcctctcttctttctctgcttgtcgatattgtctgtgtgattcagagaattggggcagttacattgtgtctgttgttgagattattaaaagattaaaacgtagttgtagaaatgaaaaattaaacagctgtgttttaaaaatgcaaaccaatatcttgttaataaaggaattcaagctatggggcagccacactcccctcctcccaggctggcataggtggccctgggctggcggcttaggaagcatggagcacacttagggtagtgcctgcctgggcaagagacacctgccgagcaaaaggaacgagaatctggggctcagagcctcgcagttgtgccaggattttcctatacatgttcaggacctctgggtagaggtttcacagtttgtgaccccataaccaccctcacccgacgtgggttctagctcagtgtgcctaatactgcatggtaacctgggcttgaccctgaagcccctgcctggcaggccacaggacctctcctgcccacttggtgctatctcttccagtgaccacccagcacgggtgagcactggccagcctggagcctgcaatccaggtggaacagactgtcctccatgtcagttccttctggcttcaggccctcaattatttccctttgagcttttttagaccctagatctcctaggcccaggctctctcttgaccccagagaagccactgtcaggaaaggaagtgaaccctactgaagccagagaattcaccccggccaaagcaggccctctgggtccagcccctcattccacaccacgccagtattgcatccatctactgcagctacacatcctgagggcagcaccacccactctggcctgctggcccatcgcaggactagcccaggcacctgccgggcattgcaggatatccagtggggcctgtgactgctccctgatgcgtcagaagagaagtgttgcactttagtggaggagctgaggagcacctgcccccttgtagcttgagttccttttggtaacagtagcagcctccatggtggtgtctgggatgcacgtgcacccgctgccttcagctgtatgtgtgtgttcctgctggagttgtgttactgacaggataatgacattacaaagaaattgtgttatattcaactttgccttgataattattgtaaacactttgttcattttttcttttttattcacaaactaaatccaccaggaaattataaagttattt

SEQ ID NO: 3597 - DNA, 716 bp, Homo sapiens
aaagggtctgtccttcctgggattcctagccgaggccagtctgctgccgtgtgcgtgtgcgtcagggctctccgggcggcaatgggggcttgagagccgggtccccagcgccgggaagggagcgcggtggccgccaccgccaccgccccggagtccggcgccgaagctgcgggcgggcgggcgggcaccagctcggtcaggggctgcttggcgcggcactgtgcggtgcagcggcggcgcggcgcggtgcgggcttttcccaggcgccccggggtcgggtggccaacggcgcggccgcgggcgctgagcgcgaccggttcgcggtagcggtggcggcggcgtgcgtgccaggggctgggggctccgccgcctctcttgcggctcaccgagctccgcgcttccctctctccagggcaggcggcttctcagagttttcaggtggcgaaactgactggtctggttagagcgcgtccaagccaagccgcagtgctgtttggatttttaaatttctccttctgagtgagaaaatagcaatcgagatggaaccatccgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaac

SEQ ID NO: 3598 - DNA, 7006 bp, Homo sapiens
gttttgatgaacacctggctttattcttgcaatgaagaaaggttctcaacaaaaaatattctccaaagcaaagataccatcatcatctcactctcctatcccatcatctatgtccaatatgagatctaggtcactttcacctttgattggatcagagactctaccttttcattctggaggacagtggtgtgagcaagttgagattgcagatgaaaacaatatgcttttggactatcaagaccataaaggagctgattcacatgcaggagttagatatattacagaggccctcattaaaaaacttactaaacaggataatttggctttgataaaatctctgaacctttcactttctaaagacggtggcaagaaatttaagtatattgagaatttggaaaaatgtgttaaacttgaagtactgaatctcagctataatctaatagggaagattgaaaagttggacaagctgttaaaattacgtgaactcaacttatcatataacaaaatcagcaaaattgaaggcatagaaaatatgtgtaatctgcaaaagcttaaccttgcaggaaatgaaattgagcatattccagtatggttagggaagaagttaaaatctttgcgagtcctcaatttgaaaggcaacaagatatcatcgctccaagatataagcaagttgaaaccgcttcaagatttgatttctctgatcctagttgaaaatccagttgtgacccttcctcattacctccagtttaccattttccacctccgttcattggaaagtttggaaggtcagccagtaaccactcaggatagacaggaggcttttgagagattcagtttagaagaggtagaaagactggaaagagacctagaaaaaaagatgatagaaactgaagagcttaagagcaaacaaacaaggttccttgaggaaattaaaaatcaagataaattgaataaatcattaaaagaggaggccatgttacagaaacagagctgtgaggaactcaagagtgacttaaacacaaaaaatgaattgctaaaacagaagaccatagaattaacacgagcatgtcagaagcaatatgagctggaacaggaattggccttttataaaattgatgctaaatttgagccactaaattattatccatcagagtatgctgaaattgataaagccccagatgaaagcccttacattggcaaatccagatacaagagaaatatgtttgccacagagagttatattattgacagtgctcaggcagtacagatcaagaagatggagccagatgaacaacttagaaatgatcacatgaacttgagaggccacacaccactggacacgcaactggaagacaaagaaaaaaaaataagtgcagcacaaactcgactatcagaactgcatgatgaaatagaaaaggcagaacaacaaattttgagagctactgaagaatttaaacaactggaagaagctatacaactaaaaaagatttcagaagcagggaaagaccttctttacaagcagttgagtggtagactacaacttgtaaataaattacgccaggaagctctggatctagaactgcagatggaaaagcaaaagcaggaaattgccggaaagcagaaggagattaaggacctgcaaatagccatagatagcctggattccaaagacccaaaacattcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaagacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgaactaaagaatattctggacatgttgcaacttgaaaaccatgagctacaaggtttgaagctacaacatgaccaaagggtatctgaattagagaagactcaggtggcagtgctagaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcagaaacaaaacaatagcctgagg

SEQ ID NO: 3599 - DNA, 1268 bp, Homo sapiens
ggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtgaggccgagctggagcccttgaaggagcagcttcgaggggcccaggagcttgcagcctcaagccagcagaaagccacccttcttggggaggagttggccagtgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattg

SEQ ID NO: 3600 - DNA, 1036 bp, Homo sapiens
atgaagaaaccgaggcccgcggctgccgcgccctctccccgccctccagcctgctcgcggggcgcccatcctgggaccgcatccgagctccgggttcccgctctaagacggggaggctgcggcgaccgcaggctcagggaggaagccgctcctgaacaggcggctgcggggccgcgcagatccaccgtgggcgccctgctggcatctgagctgggatggaaattctatgatgctgatgattatcacccggaggaaaatcgaaggaagatgggaaaaggcataccgctcaatgaccaggaccggattccatggctctgtaacttgcatgacattttactaagagatgtagcctcgggacagcgtgtggttctagcctgttcagccctgaagaaaacgtacagagacatattaacacaaggaaaagatggtgtagctctgaagtgtgaggagtcgggaaaggaagcaaagcaggctgagatgcagctcctggtggtccatctgagcgggtcgtttgaggtcatctctggacgcttactcaaaagagagggacattttatgccccctgaattattgcagtcccagtttgagactctggagcccccagcagctccagaaaactttatccaaataagtgtggacaaaaatgtttcagagataattgctacaattatggaaaccctaaaaatgaaatgacaatgattttgtatcagtggtccaaacagaactaagcataaatcattgtgccatcccaaacctcgttccagccgccttgcccatactagattctaaatgtttctaaaggcaaaccccaatgtgtcaagacagacttgtttaggtgtaattttaggaattatgctggttcatcaggaagcagagggggagttttaaaagtcaagcttaaattgaagtttaaattcatctataaccaaatcaaatgatcagaggaaattctgtaatcaatgctggaaatcgttacattgtttagaacattcttgctcatgcctgtatttgcacaaataaatgaaacttcgctgtc

SEQ ID NO: 3601 - DNA, 1910 bp, Homo sapiens
ataaccatgaacttccatatctgtcataggaaagaggttggcctcagcagcaatgagggataattctttcaagaaaggaatgaagagagaagttagatggaaaagagatttttaaggtcaaaagaagcagctgaagaacatgtgtaggacagccttaggagttactacacttcaagacctgggtgtctgctggaggaaggaacatgaccctgcggagatgttaagggttgggagagctgagcttggaggctggaagcccagctgggaggctattgttaaagaggttgctgcagcaactggtcacacagtagtgttggtagaccagacagaggacatcctggcaaaatccaaaaagggaattgaggaaagccttaggaaagtggcaaagaagaagtttgcagaaaaccttaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggcagaa

SEQ ID NO: 3602 - DNA, 804 bp, Homo sapiens
cggggccggggccggggccggagccggagccggggccgggcggcgcgcctgtggagcgctgggggcggcctggggctgagcatggagcagcgcggcggaggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctgg

SEQ ID NO: 3603 - DNA, 1280 bp, Homo sapiens
agtaactgactacttttctcccttctctagggtcctagcacagtgtctgatggagctttcctaccagaccctgaaattcacgcatcaggcgcgggaagcggtatatcgatacagcaaatgctttggagcaagaaactaaactggggttacgacggtttgaagtttgtgacaacattgatcttgaaactattttgatggaatatgagagttattattttgtaaaatttcagaaataccccaaaattgtcaaaaagtcatcagacacagcagaaaataatttaccgcaaagaagtagagggaagaccagaaggatgatgaacgacagttgtcaaaatcttcccaagatcaatcagcagaggccccggtccaaaaccacagcggggaagacaggggacaccaaatcgctcaataaggagcatcctaatcaggaggtagttgataacactcgcctggaaagtgccaacttcggcctacatatatcaagaatccgtaaagacagtggagaggaaaatgcccacccacgaagaggccaaatcattgacttccaagggctgctcacagatgccatcaagggagcaaccagtgaacttgccttgaacaccttcgaccataatccagacccctcagaacgactgctgaaacctctgagtgcatttattggcatgaacagtgagatgcgagaattggcagccgtggtgagccgggacatttatctccataatccaaacataaagtggaatgacattattggacttgatgcagccaagcagttagtcaaagaagctgttgtgtatcctataaggtatccacagctatttacaggaattctttctccctggaaaggactactgctgtacggccctccaggtacaggaaagactttactggccaaagctgtggccactgaatgtaaaacaaccttctttaacatttctgcatccaccattgtcagcaaatggagaggggattcagaaaaactcgttcgggtgttatttgagcttgcccgctaccacgccccatccacgatcttcctggacgagctggagtcggtgatgagtcagagaggcacagcttctgggggagaacatgaaggaagcctgcggatgaagacagagttactggtgcagatggatgggctggcacgctcagaagatctcgtatttgtcttagcagcttctaacctgccgtgcttgaaagccattgcactccagcctggcgacagagcaagactccgtctcaaaaaaaaaaaatgtactagtccattttcatgctgctggtga

SEQ ID NO: 3604 - DNA, 850 bp, Homo sapiens
gtccctcaaggccggaaagaaagtcgggcttctctagcccctggaggactcgactcactggtgcgcgatttaggtccggaggaggcgttgtgagagctgcttggaaagaggaccaaagacgtctaaaaagtcatttggaaatatctctaaatatttgttaccatgtataagctgctaaagagaaattgggcccaacaaaactaattgaataattgaggcagatttgtgtgtatcatcaaattctatccagaagttgaagaatctgaatttaaagattgtgtgcatttaataagaggatgacctttcagtttaatttcactatagaagaccatctggaaaatgaattaacacccattagagatggagctttgaccctggattcctcaaaagagctgtcagtctcagaaagtcaaaaaggagaagagagggacagaaaatgttctgcagaacaatttgacttgcctcaggatcacttgtgggaacataagtcaatggaaaatgcagctccctctcaagacacagacagtccactcagtgcagccagcagttcaaggaacttggagccacatggaaaacagccctccttgagagctgccaaagagcatgctatgcctaaagatttaaagaagatgttagaaaataaagtcatagaaacattaccaggtttccagcatgttaagttatcagtagtgaaaaccatcttgttgaaagagaacttccctggagaaaacatagtttcaaaaagcttttcttctcactctgatctgattacaggtgtttatgagggaggcttaaaaatctgggaatgtacctttgacctcctggcttatttcacaaaggccaaagtgaa

SEQ ID NO: 3605 - DNA, 603 bp, Homo sapiens
tttgttgtgagctgcggcagagactggtggctggaggagacgccggcgctggagagtgcgctgcgccgcccgccgctgagggaccgcggggttagccactgctggctgcttccagtgttcgccgagaggtgtggaaattaaaagaacacacatattttgactggggctttgatcaaccaaatgctaaaaagccacataaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttccttgccatagagctgtgctctcagcctgtagcagctacttcagagctatgttttgtaatgaccacagggaaagccgagaaatgttggttgagatcaatggtattttagctgaagctatg

SEQ ID NO: 3606 - DNA, 1228 bp, Homo sapiens
gccctcatagggcagaatgggactcttgctgatgtagacgccgaagtcgcgggcgctcatggcgggcctggaggtactgttcgcatcggcagcgccggccatcacctgcaggcaggacgcgctcgtctgcttcttgcattgggaagtggtgacacacggttacttcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggctacgatgacatgtacctgtgaaggcctcaagaatgtaacatcccaggcttccctccattctcctggagctgccaccgctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggtttcccacttttct

SEQ ID NO: 3607 - DNA, 520 bp, Homo sapiens
gccctgaccttctctctgagagccggggccgcttctgcgcaggatggaaggtgcccctgcggggccaggaggccggacagccgcctgcttcagttgcacatcacgatgcctttctcgtcgcccatggaagcggagctggtccgcaggatcctgtcccgggatgccgcacctctcccccgaccaggggcggttctgaaggacttcaccgtgtccggcaacctactgtttatccgactgactgctgcagaccaccgccaactgcagctctccatcagctcctgtctccagcagctttccctgttgatgtggatcacgcagtgctttctgcccgtgtttttggctcaggctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaagctgagctacg

SEQ ID NO: 3608 - DNA, 2593 bp, Homo sapiens
gatgattttcagttttgaaaacgtggtgcatttcttttctgcttagttcaaacctaaaggcaattgtttatttagaaatgaagtctattggtgtaaagactgtcaaggtttgtgggtcaaagagctctgtacgcatagaaggtcagccatgttcattaggccagagtagaaggaaagtcaagcttatgggtgaacggtcgtatactctttcaattggcaacggagactacttttgggcaaataaagaaatgctgtgggattatgtgcagactctgtctgatcagggagcagagaaacatgaaggcacaggtcagtcctctgggatcactgatcaagagaaggagttatccaccaatgctttccaagctttcacatctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcagcagtaaaagccatgatggagataaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaccttgaactgcagaatggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatacttcacttttggaaaactgttacctgagacccaggggagaatttactggccattttagttgtatcacagcagaatgaataaaagatggtgaaggctgtt

SEQ ID NO: 3609 - DNA, 3080 bp, Homo sapiens
gaagtgagtagtgggggtgccagaccaggtgcgtctgccgctggattgtgataggaagcagagtgttcgtgtgaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgctgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaaatg

SEQ ID NO: 3610 - DNA, 810 bp, Homo sapiens
gcgtgagggcctgcgctggagccggcttgacagggtctgagggggagtggagaactgggcgaggaggttcccgtggtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactg

SEQ ID NO: 3611 - DNA, 3848 bp, Homo sapiens
gttgtgagctgcggcagagactggtggctggaggagacgccggcgctggagagtgcgctgcgccgcccgccgctgagggaccgcggggttagccactgctggctgcttccagtgttcgccgagaggtaccgggggtgacagctccgggaccggccgaaaggcgaggaaccggaagcccgggggagtgcgaccgcctcaaatccagccttcttgtttggtgggacgaccgtcggttctgtccgggaggaatgacggggtcaaggtgtggaaattaaaagaacacacatattttgactggggctttgatcaaccaaatgctaaaaagccacataaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttccttgccatagagctgtgctctcagcctgtagcagctacttcagagctatgttttgtaatgaccacagggaaagccgagaaatgttggttgagatcaatggtattttagctgaagctatggaatgttttttgcagtatgtttatactggaaaggtgaagatcactacagagaatgtacagtatctctttgagacatcaagcctctttcagattagtgttctccgtgatgcatgtgccaagttcttggaggagcaacttgatccttgtaattgcttaggaatccagcgctttgctgatacccattcactcaaaacactcttcacaaaatgcaaaaattttgcgttacagacttttgaggatgtatcccagcacgaagaatttcttgagcttgacaaagatgaacttattgattatatttgtagtgatgaacttgttattggtaaagaggagatggtttttgaagccgtcatgcgttgggtctatcgtgccgttgatctgagaagaccactgttacacgagctcctgacacatgtgagactccctctgttgcatcccaactactttgttcaaacagttgaagtggaccaattgatccagaattctcctgagtgttatcagttgttgcatgaagcaagacggtaccacatacttgggaatgaaatgatgtccccaaggactaggccacgcaggtccactggctattctgaggtgatagttgtcgttggaggatgtgagcgagttggaggatttaatcttccatacactgagtgctacgatcctgtaacaggagaatggaagtctttggctaagcttccagaatttaccaaatcagagtatgcagtctgtgctctaaggaatgacattcttgtttcaggtggaagaatcaacagccgtgatgtctggatttataactcacagttaaatatttggatcagagttgcctctctcaataaaggcagatggcgtcacaaaatggctgtcctccttggtaaagtatatgttgtcggtggctatgatgggcaaaacagacttagcagcgtagaatgttatgattccttttcaaatcgatggactgaagttgctccccttaaggaagccgtgagttctcctgcagtgactagctgtgtaggcaaactgtttgtgattggtggaggacctgatgataatacttgttctgataaggttcaatcttatgatccagaaaccaattcttggctacttcgtgcagctatcccaattgccaaaaggtgtataacagctgtatccctaaacaacctgatctatgttgccggtggactgaccaaggcaatatactgttacgatccagttgaagattactggatgcacgtacagaatacattcagccgtcaggaaaactgtggtatgtctgtgtgtaatggtaaaatatatatcctgggcggaagacgggaaaatggagaagccacagacactattctctgttatgatcctgcaacaagtatcatcacaggggtagctgcaatgcccaggccagtgtcctatcatggctgtgtgactattcatagatacaatgagaaatgctttaaactctgaagacaggatacctcaccgaagaagccacactgatccaagatgggaggttttaaaaactctacagtgggaacttcacatatctcctttgtgccatatgcaaaaaatagtaaaaataataatttggtgcctttctcctcaaaatatcaatctttcaaactataataaagcctttcctataattgaaaaaaaaaacttttttgttaaaggtaatggtggttgttacttggcctttgaagagtgtacctttgtaagtatttgtaagaagtctatgtgaattaggaaatgtctgtctgcataccttttaggagcgtgtgaatggtgtcttcacttattatgtatgtttatctgtatgtatattccttattttgtcatatatgtagagaaaattgcatgacttgaggcatcatttaggttgaagaagttaatgcttaggatgcattctaggagaaaaaatcagttttaaaaacctttgttgttaacaaagtatatccagattggttaattttattgaagggtttttttctgtaattgataaaaatgtaatgacaacaattcaggcatcataaaatactgaactattgtgactttattcttagaattgctgtcttacattaaacatgtttttagggggaagttaggtaggagatagaaaaataagtgcccctacaagggggattaaaattacaagttaattcctaagagaaaaatggaatggcctttgaaggaaaaatgacccactatggctctcaaagtttttatgcatcatctcttcaatcctctaagaaagcctcttttcttaacttgataaagcagtggaaacccattttgcaatattgttttgtgaaaaacagggacagacagccaggtacagagactcacacctgtactcccaactactcagcaggctggggcaggaggattgcttgagcccaggagtctgaggctacagtgagctatgaacgcacacggcaccctagcctgggcaacaggttgcgacactgtctcaagagaaaagaaaaagaaaaatagggataggttttccttcctagcccagtagagtttgacctcattagtatggtgctttgggtgaggacctcttccttgattatcccactttctagtgaacagctaaaattcctgagagtctctactgttaaggtacctttaataggataaagcagggaccacctatctcagtgggtccatttttcttttaaaattagttatctgaaaaaacttagcagtagttcccatctttaaggtaagtctttcatttggtccccattgtgtaaaatactaatcaacattttcaagcttctgtacaacagactgcttttgtctagatttctcaactccactttataaagcttatcagttttcagagaggaatgtgaattttttttctaatgcaaataaatggatatggcaggaactacagcataagtgattattgtgattctgggtggacggatataatttacaacatttagggatgttctaggtagcctgctgtagtttgacttccagtcactgttgtctttcacattataatttgtatatttcttgtgatagaagggatgatgcaaatatgtaattaaagtgtcaccagatttctgttaaaaccaaggttgaaataaaaagcctaacattggtaagcta

SEQ ID NO: 3612 - DNA, 3478 bp, Homo sapiens
aacagaccgccgtgagagaggaggggtgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagctggtggtgtctgtcgattgactgagtgctggagctggcagccctgtgcaggctgccacctttgcccctttactgtgcttgctcctgactctatgtcgcgtctccaaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 3613 - DNA, 923 bp, Homo sapiens
cttatgtcaatgctgttgattcaaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagagttacagagtgattatacagaagatgcaacagatactaaacctgatagggatatcgagttagagctttcagcacttgatactgatgaacctgatggacaaagtgaaccaattgaagagatcttggacatacagcttggtatcagttctcaaaatgatcagttgctaaatggaatggcagtggaaaatgggcatccagtacagcagcaccaaaaggagccaccaaagcagaagaaacagagtttagggaggagcaaaaaacaattctgccggtaacttcttgctttagccagccactcccagtgtctattagcaatgcaagttgcctccccatcaccacatctgtcagtgctggcaacctcattctgaaaactcatgttatgtctgaagataaaaacgactttttaaaacctgttgcaaatgggaagatggttaacagctgaaaggaggttcatctttcaaatttgtgaccacaccatggaagcatttacactagctttttatatatataatatatattatataatgtatattttttttaaaaaaaagatattactgggggcatccatttcctgtggactctttgatacttcaagccctcttgcattagcattatgaaaaaaaaaaagaaaa

SEQ ID NO: 3614 - DNA, 2107 bp, Homo sapiens
aaaatgctcccgccgacgcacagcagtgacgacacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaaccagcacatttagcttctcttttttctttttaaataaatattgaatatgattctgttc

SEQ ID NO: 3615 - DNA, 2108 bp, Homo sapiens
ggggccgcaccgtaaatgggtgtcgcctttcctccagtccactctgcacccaacctcagcgggcgcacttttctgagttgcgcataccctctcaattattaaaggttgcagacggaaaagttagtagttttcggaattgtagaatacgctcgtgcagcgccaggacggctaatgcttacccgaaaatgtggaaccctgatctccccatgcgtggagcgaggttggaggtagcgtagtaagaatactggagttgcttaaacgcatttgctcgaaagtcactaccctggatatacattctggccaaaagaaagggggaaaaactccacatttttctcaaatactgagtttcatgaagagaacctccaacaaatggtatataaaggaaaacaaagcaaacaaaagagggaaactttgcaatttattaactcaagcatgaaaatacagaaaataaagagggctcaacatacttggaaaaggaaaaaacatgaagaaaaaacatgatggcattgtttatgaaactaaagaagttctcaatccatctcccaaagtaacacattgttgcaaatcactgtggttaaaatacagttttcagaaggcatacatgacccaacttgtcagctcccagccagttccagccatgtcaaggaacccagatcataatctactttctcagcccaaggagcatagcattgttcagaagcatcaccaggaggaaataattcacaagttggccatgcagctgagacacattggggacaacattgatcataggatggttcgagaggatcttcaacaggatggcagagatgcactagatcattttgtcttctttttctttagaagagttcaggtgttgctgcattttttctggaacaaccatttgctgtaaaaggaaagtaaaggtcaagtggtcaagttctgttttctttttaccctctgagaaacatgaatcccactgggacagatgggaagaacacccttctccgtctccctctttttgtacccatcactgttggtctacacccagtttgttgaagaactgcgggttcacgagccatttgtctcttcggaggagctagctatgagatgtctgcgatcacatcacggtaaagcccaaggagtaattaggaccccaggaagccttgctgcccagaaaacaccagcgctgtggatggtcccagggctccttgtgaggaaaccttgaacatttccttccaggaatgaaagagaacctcgtcctcaaactaaaggccacagaaatgggcactacctcctggcccactccctgggcaccatgccctctggtgacctgttggctccactcttgtcactcatgtccagatctgcagtgccagcttctccttctcggtgacatgtcacctccctgccccaatcctggctccaaccctctctggaaaatcgaagtgaaacatttgtctctaatactcaaattcaacatatggctcatctcatctaccttcccatttccatgcctagaggccccactactaccactagcaccgttgggtgtttccttctcaggctctgattctacaacatttacgttcttttctcacctttgatcccctcactcctctgtgacccccttcaagtcttccttcaccactccagtgttttcccataccactcgaccctgctcgaaggtatctttccctgctctgtcatcctcttttaggcatgcctgcttaaaatcgggagtgcttagtccttggccaacagtcctgccttctagaagaatgtaagacctgaaagagttatgaatctatcactaggcaaaaacttctcttttcctattgctggatggttttgctattattggttggtgggccctttgcctgtggaatgtatttcactcattctctcctgcacgctgttaggcagttctttcacctgcatgcttcttcttttacctttttgtctacctcatagtccctctctcccctcctttaaaagaattataaatattaggaaagcttgttgttataaattaaaagtttacatatgtatcttgagttcttcataggggaagtgttattttaaaaaattctaaaaatgaaataaatattgttattttattgagcatgaaa

SEQ ID NO: 3616 - DNA, 2359 bp, Homo sapiens
gcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagcacctggcctatctcattgcagaccagggccagctcctgggggccggcaccctcaccaacctctctcaggttgttcgccgcaggacccagcggaggaagtccaccatcactgctctgctcttcggggaggatgacctggaggcactcaaggccaagaacatcaagcagacggaactggtggctgacctccgggaagccatcctgcgcgtggcacgccacttccagtgcacagaccccaaaaactgcagcgtggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacaatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggttggatgaagatggcaaagtcctgaccccggaggagctgctctaccgggctgtgcagtctgtgaacgtgacccacgatgcagtgcatgcacaaatggatgtgaagctccgctcactgatctgcgtggggctcaagtgagtgtggaaaaggggttggaggagagccctggagtggggggacccagcccagcatcagggggggtccttacagggaaccctaaaggacaaagaacctcaggggctcaggtccttccccaaagagggtggtctgggagctgctgagagacaggtcagaggcttccaccgtggctgcagccagaagggcctggagctgcccctgctccccactcctggccatgtccccagtgagcaggtgctgcacctgtggctggaggtgctctgctccagcctgcccaccgt

SEQ ID NO: 3617 - DNA, 452 bp, Homo sapiens
ctggcaggggacgagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggcataatagtggatccttgaatgttgaagatgtccttaccagctttgacaatacaggaaatgtgtggagtttttctagaggaaaa

SEQ ID NO: 3618 - DNA, 3478 bp, Homo sapiens
aacagaccgccgtgagagaggaggggcgccggccgggattcgcggcccggagctcgggaccggagtcaggaatggagagaagggtaatggtgttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagctggtggtgtctgtcgattgactgagtgctggagctggcagccctgtgcaggctgccacctttgcccctttactgtgcttgctcctgactctatgtcgcgtctccaaggagaagaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccctagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttataagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 3619 - DNA, 2952 bp, Homo sapiens
cgccaaggaaagatgggacctcccggcccagtacttaaattcacatagctgcagagtggatatttgtcccagattaacaaagaagcatcagaaacctatggcctcccccctgcacctccaagaaacccaaactctagaggttctagccattaagtattagagttggagaagatctcagtggacagtgtgtggtgaacctccacccctgtgacaggctcaagacttctttggatataggaaatgttctcttgaaggtttcttgagcaagaattttgttccagcactgccagccacaatgaataactcttcttcagagacgcgaggacacccccacagtgcctcctctccttcagagcgtgtgttcccgatgcccctgcccaggaaggcgcctctcaatattcctggcaccccagtcctcgaagactttcctcagaatgacgatgagaaggagcggctgcagcggaggcgctcgagggtctttgatctgcagttcagcactgactcacctcgcttattggcctccccctccagcaggagtattgacatttcagctactatccccaagtttacaaacacgcagattacggaacattactccacctgtatcaaactgtccactgaaaataaaatcactaccaagaatgcttttggtttgcacttgattgattttatgtcagagattcttaaacagaaagacaccgaaccaaccaactttaaagtggctgcgggtactctggatgccagcaccaagatctatgctgtgcgcgtggatgccgtccatgccgatgtatacagagtccttggggggctgggcaaagatgcaccgtctttggaagaagtagaaggccatgttgctgatggaagtgctactgaaatgggaacaaccaaaaaggctgtaaagccaaagaagaagcacttacacagaactattgagcagaacataaacaacctcaatgtctccgaagcagatcggaagtgtgagattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaagcgcccttgcagcagtgtgcagaagatcgccagatctgcccttccctggccgggttccagtttacacagtgggacagtgaaacacataatgagtctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccaggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacaagatgctccttcccaatcagaaaacaaaaagaagagtacaaaaaaagattttgaaattgactttgaagatgatattgactttgatgtatattttagaaaaacaaaggctgctactattctgaccaagtccactttggagaaccagaattggagagctaccacccttcctacagatttcaactacaatgttgacactctggtccagcttcacctcaaaccaggcaccaggttacttaagatggcccagggccatagggtagagactgagcattatgaagaaattgaagactatgattacaacaaccctaacgacacctccaacttttgccctggattacaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtcaaacttggtagctgagcctcagaaggtaaataaaattgaaattcactatgccaagactgccaaaaagatggacatgaagaaactgaagcagagcatgtggagtctgctgacagcgctctccggaaaggaggcagatgcagaggcaaaccacagggaagctggaaaagaagcggccctggcagaagtggctgacgagaagatgcttagcgggctcacgaaggacctgcagaggagcctgccccctgtcatggctcagaacctctccatacctctggcttttgcctgtctcctacatttagccaatgaaaagaatctaaaactggaaggaacagaggacctctctgatgttcttgtgaggcaaggagattgagttcactatggagaagtcagcagcaggaggcccatcccttactcagttgccgggacatccccagtctcgggggaagaagatgccatgggcttatacccaggctgtagccaactaccaacgtgcctgtttgtttgttgctctttccttctctccatcatagtctgggtgccagcgccctgaagctccgtgctcaactgattaaactttactgccctatggtgaccatctaggagaggggagggcagagggggtgagggtactattctggattgagaaaacctatatccattctttatatcaatgtatagttttagtctcctaaattgatctgttattttccaaactattctcttgtagaaaattttccagtgggcacttaatggtgcccttgaagaacttcctaatccatgtacataaaatacatcatatgtacacttataaatgtatatagaatgctcaaaaat

SEQ ID NO: 3620 - DNA, 1804 bp, Homo sapiens
atccgttagaaggagcattgaggagtagatacccacttgccatggcctgtgggccgggggatcttcaaagccttacatctccgctttcctctgccagattagattatcagccgtctattgaagggccctggctccgggcctgcggtcagaccaacgtgtcctgcagggtggtgaaggggaagctggtagaggtaggcaagtggccatggcagagattcaaggacctcagcctgtactccgtgatggtgggagtccaccagcgcccagaaaatagcactcagctcccgctcactcgcatggtgattcataaggatttcagcaatctcatgtctcaggacattgccctcctaaagctcagggactccatctcgtggtcccccttcgtccagcctgtctgcctccctaacatcaaattcaagccatccattggaagcatgtgctgggtaatcggctggggaactacagggaaaaaaggttgactctggaagctcccttgtctgccaaatggacaagacctggattcagataggagtggtaagctggagctttagttgtggccagcgccacttcccagttccttgggcaaagccccactggaggggctggagggaaagtagggtcacttggagatcctggatgccagcccctgaggtttggtcttcatctcactgcgggaggggtgacaccatgagccagtccagggcaatgggctgcgaggccggcctcgccttctctggcagaccccgaccacccagacactgccctcgaccaccatggagacccaattcccagtttctgaaggcaaagtcgacccataccgctcctgtggcttttcctacgagcaggaccccaccctcagggacccagaagccgtggctcggcggtggccctggatggtcagcgtgcgggccaatggcacacacatctgtgccggcaccatcattgcctcccagtgggtgctgactgtggcccactgcctgatctggcgtgatgttatctactcagtgagggtggggagtccgtggattgaccagatgacgcagaccgcctccgatgtcccggtgctccaggtcatcatgcatagcaggtaccgggcccagcggttctggtcctgggtgggccaggccaacgacatcggcctcctcaagctcaagcaggaactcaagtacagcaattacgtgcggcccatctgcctgcctggcacggactatgtgttgaaggaccattcccgctgcactgtgacgggctggggactttccaaggctgacggcatgtggcctcagttccggaccattcaggagaaggaagtcatcatcctgaacaacaaagagtgtgacaatttctaccacaacttcaccaaaatccccactctggttcagatcatcaagtcccagatgatgtgtgcggaggacacccacagggagaagttctgctatgagctaactggagagcccttggtctgctccatggagggcacgtggtacctggtgggattggtgagctggggtgcaggctgccagaagagcgaggccccacccatctacctacaggtctcctcctaccaacactggatctgggactgcctcaacgggcaggccctggccctgccagccccatccaggaccctgctcctggcactcccactgcccctcagcctccttgctgccctctgactctgtgtgccctccctcacttgtgggccccccttgcctccgtgcccaggttgctgtgggtgcagctgtcacagccctgagagtcagggtggagatgaggtgctcaattaaacattactgttttccatgcc

SEQ ID NO: 3621 - DNA, 2903 bp, Homo sapiens
ggggtgtggctctgccggcccaggcgcgatgaggcggctgcccgctgggtggcgccgatttcccggggaggtcccttctgggcccccggcggaggtgggagagagtcaggcaggagccgaggccggggagccctcttcgtcagctggtgctcactgcgccgcgccagcgccagccgggactcacccgcagctccatgcttgtgcccggttcgactcgtccatactccaagaagaggcagaattctaagagtgcccagggtctggctggtcttcgaaaccttgggaacacgtgcttcatgaactcaattctgcagtgcctgagcaacactcgggagttgagagattactgcctccagaggctctacatgcgggacctgcaccacggcagcaatgcacacacagccctcgtggaagagtttgcaaaactaattcagaccatatggacttcatcccccaatgatgtggtgagcccatctgagttcaagacccagatccagagatacgcaccgcgctttgttggctataatcagcaggatgctcaggagttccttcgctttcttctggatgggctccataacgaggtgaaccgagtgacactgagacctaagtccaaccctgagaacctcgatcatcttcctgatgacgagaaaggccgacagatgtggagaaaatatctagaacgggaagacagtaggatcggggatctctttgttgggcagctaaagagctcgctgacgtgtacagattgtggttactgttctacggtcttcgaccccttctgggacctctcactgcccattgctaagcgaggttatcctgaggtgacattaatggactgcatgaggctcttcaccaaagaggatgtgcttgatggagatgaaaagccaacatgctgtcgctgccgaggcagaaaacggtgtataaagaagttctccatccagaggttcccaaagatcttggtgctccatctgaagcggttctcagaatccaggatccgaaccagcaagctcacaacatttgtgaacttccccctaagagacctggacttaagagaatttgcctcagaaaacaccaaccatgctgtttacaacctgtacgctgtgtccaatcactccggaaccaccatgggtggccactatacagcctactgtcgcagtccagggacaggagaatggcacactttcaacgactccagcgtcactcccatgtcctccagccaagtgcgcaccagcgacgcctacctgctcttctacgaactggccagcccgccctcccgaatgtagcgccaggagccacgtcccttctcccttccccgtggtggccccgctccctaaattttttaaaaagacaaaaacaaaacaacaacaacaacacacaaacctgacaagagaaaaacaaacctgaagctgccgagcaggagtggatgcagcctgatcagggtctggagcaaggagccgggctttcctgagctgtggcccggcagggaagatcgcctggacgtggagccagcatcgccccgtgccctcggcgtttgcatttgtaaacttgtggtcttcctatgtgtcagaaacaactgtgtcttgggggggaagaccctcgctgcgccgcttcccgccgcagcgcccgcgcctccgaggggacagcgccctctggagctcgctgggagcatcaccgcctggacgcccgcgccgcggaggagccggcgcccatctccacccgcacggctcgccggtccagagccatgagccaagagccctcttcacgctgctaactccaggggacagacgaagggacatctttggaaaacgctggttttggtttttaaaaagcccaactttttttttttaatttccataactaaagtgttcagactggagtgctctccttcaggcctcttcatagctgggacgttgcactggtccttttattgcttttccaagtacaactttctaatgctagccctccgtggtgctaggtgggcgttggccaggccccaagcacagccacagtagacctgggatctaaaacaagtttctgttttgggggtttgggttttttttttttttttttaatgttttgaatggaatttagttgcctccaagaattgtgccttatagcatttggggaccagggggtaactgcccctcctgaaatatccctcagcctcttcccttttccccagtgctctgttcaaacccgcctgggaaagggatcctgcccttagccctggctcgttgtgcattgcagtgaggcaaagaagaaagcaggtagattccttccgacagggcatcaagttcttcccgcccacgtcctctagcccacccctggtctgctccccagctgtttgaaggatagcacaagcccctcgtccctagagcttctctcccttttatttattctcttaacatccctttccccctggccttcctgcccccgcccccttctcagagcctcctagacaataggccctttggaccgagtttctcagggatgcccaggccacccctcagctcttcttagcgctggtctccagtcctgccctgggagctggagcctgggtatttggggacatcttgcctcagttgtatggttctttcctgtgggctcaattttgccctacatagttggataaaactctgtgctgtcctggagagtaaagctgttcacccacacagctgggcccggcttgtgccccgtggagcctggcacattccaggctcctaggaggaggcatcagagaaagacaccctgagttttactggcctgacacccttctccagagaagacctgtgaacctgagcccaagggcaagtgtacacttgtttactgtgtaagcaagagtagaagaatgtctaatgtacagtggaaccttgtacagaataaataatagctttgagaaatca

SEQ ID NO: 3622 - DNA, 3045 bp, Homo sapiens
gatggaccccggcgacgccgccattttggagtcttccctaaggatcctctaccggcttttcgagtcagtgctgccgccgctgcccgcggctttgcagagcaggatgaatgtgatagaccacgtgcgggacatggcggccgcggggctgcactccaacgtgcggctcctcagcagcttgttacttacaatgagtaataacaaccctgagttattctccccacctcagaagtaccagcttttggtgtatcatgcagattctctctttcatgataaggaatatcggaatgctgtgagtaagtataccatggctttacagcagaagaaagcgctaagtaaaacttcaaaagtgagaccttcaactggaaattctgcatctactccacaaagtcagtgtcttccatctgaaattgaagtgaaatacaaaatggctgaatgttatacaatgctaaaacaagataaagatgccattgctatacttgatgggatcccttcaagacaaagaactcccaaaataaacatgatgctggcaaacctgtacaagaaggctggtcaggagcgcccttcagtcaccagctataaggaggtgctgaggcagtgcccattagcccttgatgccattctaggcttgttgtccctttctgtaaaaggggcagaggtggcatccatgacaatgaatgtgatccaaaccgtgcctaacttggactggctctctgtgtggatcaaagcgtatgcttttgtgcacactggtgacaactcaagagcaatcagtaccatctgttcactagagaaaaaatccttattgcgagataacgtggacctattgggaagcttggcagatctgtacttcagagctggagacaataaaaactctgtcctcaagtttgaacaggcacagatgttggatccttatctgataaaaggaatggatgtatatggctacctactggcacgagaagggcggctagaggatgttgagaaccttggatgccgccttttcaatatctctgatcagcatgcagaaccgtgggtggtttctggctgtcacagcttctatagcaaacgctactcccgggccctctatttaggagccaaggccattcagctgaacagtaatagtgttcaagctctgctacttaagggagcagcacttaggaacatgggcagagtccaagaagcaataatccactttcgggaggccatacggctcgcaccttgtcgcttagattgttatgaaggtcttatcgaatgttacttagcctccaacagtattcgagaagcaatggtaatggctaacaacgtttacaaaactctgggagcaaatgcacagacccttacccttttagccaccgtttgtcttgaagacccagtgacacaggagaaagccaaaacattattagataaagccctgacccaaaggccagattacattaaggctgtggtgaaaaaagcagaactacttagcagagaacagaaatatgaagatggaattgctttgctgaggaacgcactggctaatcagagtgactgtgtcctgcatcggatcctaggagatttccttgtagctgtcaatgagtatcaggaggcaatggaccagtatagtatagcactaagtttggaccccaatgaccagaagtctctagaggggatgcagaagatggagaaggaggagagtcccacggatgccactcaggaggaggatgtggacgacatggaagggagtggggaagaaggggacctggagggcagcgacagtgaggcggcccagtgggctgaccaggagcagtggttcggcatgcagtgagggggcggcagctccatggccgcagtggcctgccctgctctgagcacttccgtggactgaaggaaccgtaggagcctgctctcagaaggacaatgattcagcatgtgattgcagcaggggtctctgccccctcgctcccaattcctagtcgtgacttcatttctaaaacagagcctgaccaaccttccatgtatctccatcctcccctgctccagccagggaggactgagggagtgccccgagacccacgcacatgttggggcttctgggccaagagtactttttatataactaatttctaaatccaaaagctcaaggaatagacagtgttctgtgacatggattggtttgaaggagttacccaccatcccagcacgataatgtcatctcccaagttggatggcagcacgatctggccctagggagcttcctgttcccagaagtcattgtcctgggctatccagatgtccctagtaaatcttgcttccttctgcaatgttagtaatgccttaagctgacagttgctattttgcagaacagttttcctctttgcttagctagtaacttgcctctgagcctgggctgatctgagaaacaggtgtgacaagagcatgaaccagaggtgcacctggggcagttccctaataaaactggtttgtacagtcatggtgttggggtgatcagaatggaagcccttttcaaaatagactcttagtatttttgtcttattcgcaatgcattgattcagccccagaattatttgccagaaatagactttcttcccctggtgttgggagccaggagggttggaaagctcaggaaccctgagctggttcatctgtttgcatattgggtaggttaatttccctggagcctgagagtctttggccagatttcagctgcgtctgcctggctcttttgctgcagctgtgagattggggtctggttccagcagtctgtcactggtcagcctgagtatcacaccctgagctctggggctgggagtttcttcccacaccctctcccttgtgccttaagttgcgatggctctgagtatacaattaatcggaggtgaggggtgggtgtcacagctaatcccaaattcaaaaattagtccaaggtgctgcaaaatataaatttgatgtcagtagaaagtcgtatcctaaaatgtaaaaactgtaagtgtacagtagttaatgagctcagaacatctgataactgcaatttaaaatgggcaaaaagtt

SEQ ID NO: 3623 - DNA, 768 bp, Homo sapiens
agtggcggaggctcggtcacccgggtgagtccccactccggctgcccgcgtccaccaaggagatgcgtgttccctttccggcttattgtctgacagaccctctgccttatcccgctggtgtcactcgggtgggggaaaccgggctgcggagaacgggccctagaggagactaagctctcttcctatccctagcctcgctgcttttctcttttgaaataataagactggcttttataaaacattttcagataggtaaaggaaaacatgcctgccacacggaagccaatgagatatgggcatacagagggacacacggaggtctgttttgatgattctgggagttttattgtgacttgtggaagtgatggtgatgtgaggatttgggaagacttggatgatgatgatcctaagttcattaatgttggagaaaaggcatattcatgtgctttgaagagtggaaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgatggatagcagccaacagaaaacatttcgaggacatgatgcccctgttttaagtctttcctttgatcctaaggacatctttctggcatcagctagttgtgatggatctgtcagagtgtggcaaatttcagatcag

SEQ ID NO: 3624 - DNA, 473 bp, Homo sapiens
cctggaaacccaccgagaacctccaccctctgacaccatggtcaactcctgttgtggctctgtgtgctctgaccagggctgtggcctggagaactgctgccgccccagctgctgccagaccacctgctgcaggaccacctgctgccgccccttgtgctgtgcctcctcttgctgctaaatctctgctgtgaacacaccacttccttattacgtcctttcctacagatgaaggctctcattgcaaacatgcggactgttcaagagaattgatctgggtcccataagcaaacctcatccttagaaattctgtatttgcattctaccttttgtccaaactcccttccttccaaaggaattcattgacaatctcctaataaattgacaaattgtcctccaacatcctcccacctctttgacttcaggacatttattcatcatgcctaaggaatttgaagattgcctccatcatttgt

SEQ ID NO: 3625 - DNA, 697 bp, Homo sapiens
tggtcggcccgagcggaccctcgcggcggccatggcgtcggtggtggaatacaagggcctcagggccggctaccactgcggctactgcgattccaaggagggcaaagcgtcctgcggcatgtgggcacattccatgacagtacaggattatcaggatctcatagaccgaggatggcgaagaagtggaaaatatgtgtacaaacctgtcatgaatcaaacatgttgtcctcagtacacaataaggtgccgacctttacaatttcagccttcaaaatctcacaagaaggttttgaaaaaaatgttgaaatttctagctaaaggggaggttcccaaaggaagttgtgaggatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggcaaaggggctgatttgagtaagcctccatgtcgaaaagcaaaggaaatccggaaagaaaggaaaaggttaaaactaatgcagcagaacccagctggagaactt

SEQ ID NO: 3626 - DNA, 859 bp, Homo sapiens
gggcggcagagctggagtgaagggagctagtggtaaagggagctggtggaggggtggcggcaggggtaaggggcaggggacaccctctagacggagagcgggctccgaggtcctggctggccctcggtgcgcccgcccctgtgttggtcccacaatccctggcaatgagaggccagggtttattggacagagtcagttgtggggttcagagggtcagcaatcaatcaatcctccgaatccagagatttagacccagtcgtccgtattaggactggaggggggtcaataggttcagtgtttgagatgccaagggaacctgtcttttgatttggggttcaacatacagagtttaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggt

SEQ ID NO: 3627 - DNA, 568 bp, Homo sapiens
agaggtgacgcttctttgggggcgggctggagttttctggccgtgaatggcagagcgctaatggccgcctccaatgtggcccaatcagaaagaaaggaaggctgggaactaagaagctattggttggtgatccctggaccaatcggaggagccgtgatttggcgggagtcttgaccgccgccgggctcttggtacctcagcgcgagcgccaggcgtccggccgccgtggctatgttcgtgtccgatttccgcaaagagttctacgaggtggtccagagccagagggtccttctcttcgtggcctcggacgtggatgctctgtgtgcgtgcaagatccttcaggccttgttccagtgtgaccacgtgcaatatacgctggttccagtttctgggtggcaagaacttgaaactgcatttcttgagcataaagaacagtttcattattttattctcataaactgtggagctaatgtagacctattggatattcttcaacctgatgaagacactatattctttgtgtgtgacacccataggccagtcaatgtcgtcaatgtatacaacgata

SEQ ID NO: 3628 - DNA, 991 bp, Homo sapiens
actctggtggtttcaggaagggatgatccaccaacacattctcagccagacagtgatgatgaagcagaagaaatacagtggtctgatgatgagaacacagccacgcttacggcaccagaatttcctgagtttgccactaaagtccaggaagctatcaattccctcgggggcagtgtctttcctaagcttaattggagtgccccaagggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcgatgttttgtcaaggaaaacaagcttattggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggattccccagctttccgttgcacaaacagtgaagtgacagtccagcccagcccctatttgagttaccggctacccaaggactttgtagacctctctactggggaggacgctcacaagctaatagacaaatcagcaggaggacgactgatgagcgtactggaactggagaagaggaggccccgccccaccgctccgggagctgctcatcagccgcaacttcctgccgaccctgatgcgggtgggccgagcagtgtggacatcagccactttttatattcatgtacattcacctggggaaaaaaacggagggactttgctacttgtaaaaataacataataaatagatcttaaacataggaaaaccatactgttctgataataaaatgctttctatgaaata

SEQ ID NO: 3629 - DNA, 1499 bp, Homo sapiens
cgcgacgggccacgcacgtccgggcgtccagttcggggcagcttctccggctgggtggcaaccaactatatctgaggaccagagccattttggggcaccagagcttgtgacctctccatctccacccagctgggtccaggggccactctcagcactcacctcagcagctgacatcataaagcagacttgggaacctggaagcactctggagaacctttccctgagacatggagctttggggccgaatgctgtgggccctcctgtctggcccagggaggaggggaagtacccggggctgggccttcagctcatggcaaccccaaccacctctggctgggttatccagtgccatagaactggtcagccactggactggggtctttgagaagaggggtatccctgaggcccgggaatccagtgagtacatcgtggctcatgtccttggagccaaaacatttcagagcctgaggccggcactttggacccagcccttgacctctcagcaactacagtgtatccgggagctgagtagccgtcgattgcagaggatgccggtgcagtacatccttggagagtgggacttccaggggctcagcctaaggatggtgcccccagtgtttattcctcggccagaaacagaggaactggttgagtgggtgctggaagaggtggcccagaggtcccatgctgtgggatccccaggcagccccctcattctggaggtgggctgcggatcaggagccatctccctcagcctgctgagccagctcccccagagccgagtcattgctgtggataagcgggaagctgctatctctctgacccatgagaatgctcagaggcttcggttgcaggacaggatttggatcatccacctcgacatgacctcagaaaggagctggacacacctgccctggggccccatggacctgattgtcagcaaccctccctacgtcttccaccaggacatggagcagctggcccctgagatccgcagctatgaagaccccgcggccctggatggtggggaggagggcatggacatcattacccacattctggccttggcaccccggctcctgaaagactctggtagtatcttcttagaagtggacccaaggcacccggagcttgtcagcagctggcttcagagccggcctgacctgtaccttaatcttgtggctgtgcgcagggacttctgtgggaggccccggttcctgcatatccggaggtctgggccatagcatggctgccctgtggatgccttgtcagtgccgccagcctgaccagaggggaggtggatggcactttccagagcccaggttcttatggcatttcccagggttctgtgatttccccatgctctgcatttctaggatatttctaggacacctggattggctccatcacatcagagtggctgagggcagttgctctgtgttggtgaaattgctgtgggggtatcgggggatatggccagtaaagtattgagagactaa

SEQ ID NO: 3630 - DNA, 1280 bp, Homo sapiens
cgcagtactggacccgagcgcgacggtgcggctggcggacccgggctggcttgtggggaaacgaaactgagggaggaggcggcggctctggcagcggcggcgacagtgtcggcctgaccccccctccgctccccggcagctcgctctctcccctcagcttaacgatgaagaggagaactgacccagaatgcactgcccccatcaagaaacagaaaaaaagagttgcagagcttgccctgagcctcagctccacgtccgatgatgaacctccctcctctgtcagtcatggagcaaaagcatctactacaagccttagtgggtctgatagtgagaccgaggggaaacaacacagctctgactcttttgacgatgcattcaaagcagactctcttgtggaaggaacttcttctcgctattccatgtataatagcgtctcccagaagcttatggccaagatgggcttcagggaaggtgaaggattgggtaaatacagccagggtcggaaggacatcgttgaggcttccagtcagaaaggtcgaagaggcttgggtctgacactccggggctttgaccaggagctgaacgtggactggcgagatgagccagagcccagtgcttgtgagcaggtgtcatggtttccagaatgtaccactgaaattcctgacactcaggaaatgagcgattggatggtggtgggaaagagaaagatgattattgaagatgaaacagagttttgtggggaagagctgcttcacagtgtgttgcagtgtaagaagccactggtgaaggaccgggaagctgagcttctgtactttgctgatgtctgcgcaggcccaggtggcttctcagagtatgtgctgtggaggaagaagtggcatgcaaagggctttggaatgactttgaagggccctaatgacttcaagctggaggacttctactctgcttccagtgaactcttcgaaccctactatggtgagggtgggattgatggagatggagatatcacccgcccagagaacatctctgcttttcggaattttgtcctggataacacagatcgcaagggtgtccattttctgatggctgatgggggtttctcggtggaggggcaggagaacctgcaggagatcctcagcaagcagctgcttctgtgtcagttcctcatggcgctgtccattgtccggacaggaggccacttcatctgtaaaacctttgacctgttcacaccgtttagtgtggggcttgtctacctgctgtactgctgctttgaacgagtttgt

SEQ ID NO: 3631 - DNA, 757 bp, Homo sapiens
cacagcttgcatcaatggtgtggaataacccaagtcagcaacaatttatgcaatttggaggaagctctggatcacagttgcctcaaatccagacagatgttgtacttccatcatgcaaaaaaaaagctcctgctgaaactcctgtgaaagaaagactttttattgtgtttaatcctcatcctttacctttagacgtattagaagatatattctgtcgttttggtaacctgatcgaagtttaccttgtgtcaggaaaaaatgtggggtatgccaagtatgccgatagaataagtgctaatgatgccattgccactctacatggaaagattctgaatggggtgagacttaaagttatgctggcagattcgccaagagaagaatctaacaaacggcaaagaacttactgattcttgagtggccctgaagctgcactatgttggaggtttccttgactaagagaaccacatgcggcattcagctcagtaggggagtcataaaagatctcgcctctgaccagaagagtatgaatgacaaaggtgacataaccagcacagaaagatgtcttagcctctgcacatcagctgatttagaatacttatgtagatagcggttggggtcgggggggtgcggaatgttcttttcagcttctttgccctgagaactttgatcttattgcaaggaagtcccttaccctcttctaccctagatctgatggacctcctgggatttcctggggaaatgaaatgagtctaacacc

SEQ ID NO: 3632 - DNA, 4222 bp, Homo sapiens
ccctgtctctactaaaaatacaaaaaaattagctggacatggtggtgggtgcctgtaatcccagctactcaggaggctgaggcaggagaatgacatgaaccttggaggcggagcttgcagtgagcccagatggcgccactgtgctccagcctgggcgactgagcgagactccgtctcaaaaaaaaaaaattctttcatttatttagttacttttagagatagagcctcccgctgttgcccaggctggagtgcagtggcagtcatagcttactgcagctttgaactcctgggctcaaatgatcctcctgcctcagcctctccagtagctgggactgactacaggcacgtgccaccacacccagctaatttttatttttatttttatttttttgagacagggttttactctgtcacccaggctagagtgcagtggtgagatcatggctcactgtagcctctgtctccggggctcaatcaatcctcccacctcagcctccccagtggctgggattactggtgcacaccaccataccctgctaattgtatttatttttagtagagatgggattttgccatgttgcccagactggtcttgagctgctgggctcaagcgatcttcccatcacagcttcccaatgtgctgggattacaggtgtgagccactgtacctggccagctttacttcttttaccagcactcctgattttataaatagtgaggcttatcaaccccatttctacccaaatcttctggtagacttgagtatagtagggcttcataggtagcagccctgtccctgtcctattatgatggtagctgttgtgatgtggcgatctctgatctagaaacccctgaggggccattgtggcctgcccagtctcccggccacggttgaaaccagacgtgcagtggggctgacccctgtgccccaccccagagtcatgccagcgtgggtggtggggcattctctgggatgaatgatctggatcccatagccatctgtgtcctgtttgaggaatgggaccctcaaacagagaacagccaagatgctcaagcaggtgtgtgcttgggccagactctgcagcctttggtttgggacttgactgccattcactgaaggggcccaggaaatgggcagctcacatggtgttgctgggtgtccagctgcggcagtttagcagaggaggacttgtaatgagatggtagcttcttataggctaagacatgatttttctgttcttttactacctcctgcaccttctagaactgttccttctctgatgctgttttcctttcttccagtgatttatctctagggtctccatagcaggggaggtagggtcagactcctgagatggctgatgtcctaccctgcccccaaccaggggccccaggagactcctttttcttactgcaactttggcctcctcagtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctgctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagc

SEQ ID NO: 3633 - DNA, 4599 bp, Homo sapiens; identical to SEQ ID NO: 3264

SEQ ID NO: 3634 - DNA, 477 bp, Homo sapiens
atgacccactgttgctccccttgctgtcagcctacctgctgcaggaccacctgctgcaggaccacctgctggaagcccaccactgtgaccacctgcagcagcacaccctgctgccagcccgcctgctgtgtgtccagctgctgccagccttgctgccgcccaacttgctgtcaaaacacctgctgtaggaccacctgctgccagcccacctgtcccacctgctgtgggtccagctgctgtggccaaaccagctgtgggtccagctgtggccagagcagctcctgtgcacctgtgtactgcagaagaacctgctactaccccacgactgtctgcctgcctggttgcctaaaccagagctgtggctccaactgctgccagccctgctgccgcccagcctgctgtgagaccacctgctgcaggaccacttgcttccagcccacctgtgtgtccagctgctgccagccttcttgctgctga

SEQ ID NO: 3635 - DNA, 3318 bp, Homo sapiens; identical to SEQ ID NO: 2439

SEQ ID NO: 3636 - DNA, 9497 bp, Homo sapiens
agaatgcagcgcatggcgcgtcattgaagagagaccatgatggcggcggcgctggggcccccagaagtgatcgctcagctggagaacgcggctaaagttctgatgcaaactctggcctgttctattctgactgcgctattgagtgaattttcaagttcaagtaaaactagcaacattggattgagcatggaattccatggtaactgcaaaagagtttttcaggaagaagaccttcgtcagatcttcatgttaactgttgaagttctgcaggagttcagcaggcgggaaaacctcaatgctcagatgtcttcagtatttcagcgttaccttgcactcgccaatcaagtcttgagctggaactttcttcctccaaaactgggcagacattatatagctatgtttgaatcctcgcaaaatgtgctgttgaagccaacagagtcctggcgggagactcttctggacagcagagttatggagcttttcttcacagtacatcgaaaaatcagagaagattcagatatggcacaagattctctgcagtgccttgcccagttagcttctcttcatggacccatcttcccagatgaaggatcacaagttgattatctagcacacttcattgagggattactgaatactatcaatggaattgaaatagaagattctgaagctgtggggatctccagcattatcagcaacctgataaccgtgttcccacgaaatgttttaactgccattccaagtgaacttttctcctcctttgttaactgcctcacacacctcacttgttcttttgggcgaagtgctgcattggaagaagtgcttgataaagatgacatggtatacatggaagcatatgataaattgttggagtcctggttaactttggttcaagatgacaaacatttccataaaggcttttttacccaacatgcagttcaagttttcaattcctatattcagtgccacctagctgctccagatggcacaagaaatttgactgccaatggtgtggcctctcgtgaggaggaagaaataagtgaacttcaagaggatgatcgagaccagttttctgatcaactggccagtgtaggaatgctaggaagaattgctgcagaacactgtatacctcttctgacaagtttattagaagaaagagtaacaagactccatggtcagttacaacgacatcagcaacagttacttgcttcaccgggttcaagcactgttgacaacaaaatgcttgatgatctctatgaagatattcactggcttattttagttacaggctacctcttagctgatgatactcagggagagactccgctaatacctccagaaataatggaatattccattaagcattcatctgaagttgacattaatacaacacttcaaattttgggatctccaggagaaaaggcttcttccatcccagggtacaacagaacagattctgtgattaggctgttgtctgccattctcagagtttcagaagttgaatctcgagcaataagagcagatctcactcatctactaagtccccagatgggcaaagatattgtttggtttttaaaacgctgggcaaagacttatctcctggtggatgaaaaactgtatgatcagataagtctgccattcagtacagcgttcggagcagatacagagggttctcagtggataattggctacctcttacaaaaagtcatcagtaacctctcagtctggagtagtgagcaggaccttgcaaatgacactgtgcagctccttgtcactttggtggaaagaagagaaagggcaaacttagtaattcaatgtgagaactggtggaatttagctaagcagtttgcaagccgaagcccacctcttaatttcttgtcaagtcctgtgcagaggacattgatgaaggctctagtcttaggaggttttgcacatatggacacagaaaccaaacagcagtattggacagaggttcttcagccacttcagcagcgattcttaagagtgataaaccaagaaaacttccagcagatgtgtcagcaagaggaagtcaagcaggaaatcactgccacactagaggccctgtgtggcattgctgaggctacccagattgacaacgtagcaatcctgtttaattttttaatggacttccttaccaattgcattggattgatggaagtttacaagaataccccagagactgtcaatctcattatagaagtttttgttgaagttgcacataaacagatatgctatcttggagagtccaaagctatgaacttatatgaagcctgccttactttgttgcaagtgtattctaagaataatttagggcggcaaagaatagatgttacagcagaagaagagcaataccaagacctgcttctcattatggaacttcttactaacctgctgtcaaaagaattcatagatttcagtgatacagatgaagtgtttagaggacatgagccaggtcaagcagcaaacagatctgtgtcagcagcggatgttgtgttgtatggagtaaacctaattctgcccttgatgtcacaggatctcttgaagtttccaaccctttgtaatcagtactacaaattaatcacatttatctgtgagatttttcctgaaaaaataccacagcttcctgaggatctgtttaaaagtctgatgtactccctagaattaggaatgacatcaatgagttcggaggtttgccagctttgcctggaggccttgacaccgttagctgaacagtgtgcaaaagcacaagaaacagactcaccactttttctagcaacacggcactttcttaagctggtttttgatatgctggttttgcaaaagcacaacacagagatgaccactgcggctggcgaagctttctacacgttggtgtgtttgcaccaggctgaatattctgaactggtcgaaacattactatcaagtcagcaagacccagttatttaccagagattagcagatgccttcaacaagctcactgcaagcagcactcctcctacgctggatcggaagcagaagatggccttcttaaagagtttagaagaatttatggcaaatgttggtggtctcctttgtgtaaaataaacaacagaactttatgcttaatttagatcctttctgcaaagtgcactgaattgctgaaagttgacttgagtcttgtcctattcctcagttcatttggccattttggattttggagagcctgaaactttgatatgtatgtaatacagtgaaacaggagaggtcaacttggcatcagcttctgctgttaagtgttagccacaatctgtcatatatatgtcttttagattctgaatggtgatttaaaattttcaaaatgaaattccatatatgtgcaaacagatatgggcaccacgaaatacatatgcagtgccttttttccttttaacataggtggctagccaaagtttagaatttttgtcattaaatatgaaatggatatatgctaggcagtgtttctcaaaatctccatagatcgcctgcatcacttgaggagctggtgaaaaggcagattcttaggcccaactgtagaccttcagagtcagaatgtctggttgttgggcccaggagtcttcatgttaataagcttctccctttcgtcaccccaaaagttttgaatcaatgaaagagacattgaaaactcttaagaggttttgtgctttctagcttttcctccctttgatgattgggttttataattcagcaggaaggggaaacatcaccaggggtttgttggctttttcttagcttgctttcttgcttgcttgctttcttgcttttcttgctttctgtctctctctttcttttctctctctctctcacatcaacccagtgctgcaggttttgtgtaatacaagtcactaatcatactctgatgcctgaacttgaggaggaaaatacatgtatatttttgttccgtaaaaataaccttaggaactgtagccatttcattgccttaattttaagaggaaaatacaaaaacagctgatttgttttagtaagaaaccacgtcttgatgcttcagagttggtttagggtgttagctgctatgaacctgttgcccctttcgatcgtgtatttatgtaggtttatcagtgaaatgaaaggcttgtttccgtctagtctaactttttgagtgtgtttctatccagccacatagcccatatctactctaaatggcttgcttaagcaataattattttaaaggatgtgaatcactgattcacacagactattgcacgttggggcattaggggcaataattcttatccagacatgggagccagtgaatttaatttcagagattaaaaattcactttagatcctctagtttgatctcttaatcaggatttttatacagctgccaggctcccctaattcagtgtgccagcttacaatgtggaaatgaaagctaatttatacacagcaggcatatgaaactccactcattgcagtactttcacagcacagtgacaggtagaggactctggcacaggtgcactcatgaaactctgcttccaccatgttcctgacacctatctattaaaccattctgcaaatacggtttttctacctgattgcatatagcatatgtgtcattacatgtgatgctgtgcaaaactttgtataattctgtgttattaacagttaacaaaactggagcatctgaattacatccaacctgtgcatgtgatgttaggtagatgtgaatgcagggccttgggccataacttacatttctctcaatttgattagctttgagtcacaattaaggggaagcaaaaacatcttgaaaagactgctaggaaggaaattaatatcagtcatccagaagtacacgtttctgtattttaaaaaatactttgatgcatttatttttaggtgttttttttttccccttaaaaaacttgaagtgatatgcagcagtaatctatttgttttgcattgttcttggtgttttgtgtttcccagatccctcaagctttctcagctgttgtgaattatgtgtatctgtgtgtgtgctaagtacagtctctttaccaaagggcactgaaacacacaattgactggacaggtccacgcgccatgacaaaactataatcaagttattaaaactaaagaggagtgggaaaggaatgccttggtaagtaaaaaggcatctatatttaataacttttatccagatggcaacatatttgcaaaatttgcccagatcctattacaatactaaaaatagaaaatttcacctccatattcctgaggtgtaatttcattagactagttttagtttaaaaagaccttcttcagattggaccaaataatacttataagatcagcagaatgttgaatattagctcactggggtggggagaagccactaccattttttaggtgatggggatgccactgagttgcaacggctagaccttttcagggtggttgtgtccatgtttgcctgattggatgcttattcactttgtgttttcttttgttttattttgtccaattttgtctttagctgtgtttattaacttctccggtcttgttttgttttaatgctcttggcccagtgggtgtcaagaacactggcttaattcaagtcagttgattttttttctattaaaactgttgttaaaatattttttaaaacaaaaacattatttgtgccctcttttatatatgtcaaagggacactgtcaagtatttcatttttagatttttgttttataaaatttctgttgttcatatagtatcctttaacctctagttttccatacatcctttgtttgtttctcattttattttccttgacccatttatttcccaaggcacaatcactaaagactttgtactttcacagtctgttaatgtggtagcacctgtaactgtgttcttgttctgttaaaaggattgatttgcttttatagtccttgtgctggatgagtggctgcctcagtagcaaaactacctgacagtatttgacagtgtcctttccagcaccattatttgggtctttcagggtggccatctctgttagaagacagtagcatgttaacatcactgcattgagtttttgtctggtgtaaagtatgacttttaatgtaaacaaactgcaggtttttttcaaactaattttaagaatttagtcttatttcgttgtaaactgtgtatctaattatattacattactctgttcagatgggatggttactaccacttgtccatgattttcatttgaaaagcaagtatctatatcatttccccccagtcagcattatttaacactccccttaactgtctttgaactttctcttttaacaaaaatgtcaagtctttatagttgtaatatcaccatgtttcccatttctgttaatacttctatgaacccctaaagtattgaagggaactagctgtcagtttcaaggattacaagtttgagtctcctagtattcaacatcattctgaaccctgaaataatatttttctctgttaaacaatttttatctgtttgccacctctgttgttagaggtggttgtcaattgaccttactaagttagctgtctttgatgaggaattattgttattggttcctgaataaaacattaaccttttaagtcagaaggaacctcggtacttcttaaggtttgtttgtgttttctaaaaccagagaataaggaactgatttggctatgaggtttaacattataattttctgtaagctttcccacaaaaaaacattgttgatttgaggatataataatgttttaatctttttaaaatataagtggttattctctgacttggtaactatgttctgaaaacactgcatttaagaatttttaaaaattggttttctaaaattaaaatgtccaaattaggcatattgctgagctcaaattgatgtgaaatgccatggttccagttgaattttaagcatattttcatttagatataaaatatatgaagtatgctttgttgattatagtgagaacccatgacatagttaaccaaagaatatgtttggttcaaataaaaatagaagcttaatactgggcattcatactttttaaagagaatgaatgaagaaatcggtttcctgctgtagttctctatgggtaagtcttagtaaagacgagaatgctgaagtcggccgtggcgattccctcctaggaactgggaggtgtggcttgcccattacccgcttgaagctcacatctttaccctcctctcccactgtggtttgatcttcacctattcccaggccctcccagcaattggagaggtgtctttttttttggttttggttttttttctccccgtctgcattcttaggcctcttagctattaggaactgtcagatacatactagtagctaattttcctagcctgaaattatatactgcatctgcactatgtacctactagggatctgacctcaagtgttttctgagcccaggcttcctggtgtggtgtcttttaccacataaaattattacaaattgcaaatgttggtattgtgatttgattatctgtacaaagaaagaagctctatgcagtgagtttgtggtttaatggtcacaaaaatgttagcactgctaccactcagcacgtgtaaaattttttaaatttataaatattaaaattttaaacttacactaagacttttcagttttatttaaagacccagggatgagtgtactgtttaaatatttacctctattaacataactaatgaaggtataaaattgcatttagtttttcagaagatgctgcaatatgattttaggaaataaggctatgtattgagccagttataggctgaatatcaggttgataaaattttatttgtatttttaaaattcataaatgggagttaaaatgtgtcttttcactaaatatttttattacatttttgttttgaccatgtgtgatttgttcatgggtatttagctagactcttttatgaaatgcattgaaatggtgctagtttgtttaccattataggaagattgacactggggacattacacggtcctaaaataattttaaatttaaaaaaatgaagacatctgtacagataaaaatcaagatttgcatcaccttctgggagaacccgtggtactcacagaatatccagtattagaaatataaaaattttgtctatattttataatatttatctcagcccacagtcttagaaacagtttcacagttactagttaagtcattatctttggtgcatatttagtaaatacttttagcaagtcattctttttggcctttcagggaaagtggtgaattaccatattactgtgtgctagatagatccaccctttgcccagtgttaaatcttgtaaacatatgaagtgaaaagttaatttttaaagaaaatgcatctttaaaatgttcatttttaacctgaatttgctttgaatattctttgatttgtaatgttgttatttagcttatattgagatttattccactccaaaggtggataaagaaaagttgtttaagaaaaccaattagagtgtattttgaatttttgtttctttcattaccaagtgtggggccatacacacaggctaatcatctgtcatttgagacccacagatgatttcaaaggtcccaaataaatacacatctataactgttttttaaaagacatctttaatggtgctctccaaaaatacaattcggttgcttatgagtgatgcctttgacaggctgattagattataaaacagttttgtttttttaaacatagggtctcagattgagtcttgtgcattctatgtaatctcaaatggcagttcagtttgactttcttttaaaactaagtggaaatggtatatttggtgaaactaatgaaagaatcttttgctgggaaattccatacagcacccccagcagcatcctgtctcagtctggcgtataattcaacctcctactgagtgtccctgtaaattatttttaatatatagcatgagagtgaactgaggtaagtcattgatgtttcccagagatgatgaatgaacaaaagcaaataggatctgctaaacatttttattcccacagtagtgagcagttttgttcttgttttgataatgttcatttctgcctaatcttaggcttcaaatacacctttaagaaagcccaagatgtattgagtagtagaacttcttatttgtacacctgtttataactgcactgccctggatgttatggttatttctaaggactgacctggtaaagctacttgaactggtagactgcagggtagaggcagacctagattcaatgtctaactaagctgcttagggcttacattaatttccacaggtctgttatccatatcatgagtttataagtgttcctcccaaagaaaaaatttaaaagtgatggatgaaatataatagtagatgctcaataaattccattgtatttaaagatt

SEQ ID NO: 3637 - DNA, 1133 bp, Homo sapiens
gagcttcgcggtgccaccgccccgcccacgcctcctcgccggcctccgagtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcagg

SEQ ID NO: 3638 - DNA, 6003 bp, Homo sapiens
ggctctgtgtatgaatgacaaggataccttcagccagctcattctggatgaatgaatgattacactaagtgtcctccacattcctctgtgggctcacttcatggactcactttgcgtgcttgttaaatgtgctgtgttgctcccaagaccatgtaaagcctactgaccactaacctccctcacagcagaaactagacgtcaggttaaaatgggcaactccgacagtcagtacacccttcaaggatctaaaaatcatagcaatactattactggtgctaagcaaattccttgctccctgaaaatacgtggcattcatgcaaaagaggaaaagtcattgcatggatggggtcacggaagcaacggagcaggttacaagtccaggtccctggcccgaagctgcctttctcactttaagagtaaccagccttacgcatcgagactcggtggccccacatgcaaggtctccagaggtgttgcctactccacgcacaggacaaatgccccagggaaggatttccagggcatcagtgctgctttctcaactgagaatggcttccactctgttggccacgagctggcagataaccacatcacctccagagactgcaacggacaccttctcaactgctacgggaggaatgagagcattgcctccaccccaccgggcgaagaccgcaagagcccccgagtgctcatcaaaacgctggggaagctggatgggtgtttaagggtcgagttccacaatggtggcaaccccagcaaagtgcctgcagaggactgcagtgagccggtgcagctgctgaggtactcacctaccttagcatcggaaacctcccctgtgcctgaagccaggagggggtccagcgccgattccctgcccagccatcgcccctctcccacggactctcgcctgcggtccagcaaaggcagctccctgagttctgagtcatcctggtacgactccccttggggcaatgctggagagctgagcgaggctgagggctccttcctggcccccggcatgcctgaccccagtctccatgccagcttcccacctggcgatgccaaaaagcctttcaaccaaagctcttccctctcctccctccgggaactgtacaaagatgccaacctggggagcctctccccctcaggtatccgcctttctgatgaatacatgggcacgcatgccagcctgagcaaccgtgtctcttttgcttccgacattgatgtgccctccagagtggcacacggggaccccatccagtacagttccttcactctcccctgtcggaagcccaaagcctttgttgaggatactgcgaagaaggactccctcaaagccaggatgcgacggatcagtgactggacgggaagcctctcaaggaagaaaaggaaactccaggagccgaggtccaaggagggcagtgactactttgacagtcgctctgatggactgaatacagatgtgcagggatcctcccaggcatctgcttttctgtggtcagggggctctactcagatcctgtctcagagaagtgaatccacacatgcgattggcagcgatcccctccggcagaacatttatgagaatttcatgcgagagttggaaatgagcaggaccaacactgagaacatagaaacatctacagaaaccgccgagtccagcagcgagtcactcagctctctggaacagctggatctgctctttgagaaggaacagggggtggtccggaaggccgggtggctcttcttcaagcccctggtcactgtgcagaaggaaaggaagcttgagctggtggcacgaaggaaatggaaacagtactgggtaacgctgaaaggatgcacgctgctgttttatgagacctatgggaagaattccatggatcagagcagtgcccctcggtgtgctctgtttgcagaagacagcatagtgcagtctgttccagagcatcccaagaaagaaaatgtgttctgcctcagcaactcctttggagatgtctaccttttccaggccaccagccagacagatctagaaaactgggtcactgctgtacactctgcttgtgcatccctttttgcaaagaagcatgggaaagaggacacgctgcggctgctgaagaaccagaccaaaaacctgcttcagaagatagacatggacagcaagatgaagaagatggcagagctgcagctgtccgtggtgagcgacccaaagaacaggaaagccatagagaaccagatccagcaatgggagcagaatcttgagaaatttcacatggatctgttcaggatgcgctgctatctggccagcctacaaggtggggagttaccgaacccaaagagtctccttgcagccgccagccgcccctccaagctggccctcggcaggctgggcatcttgtctgtttcctctttccatgctctggtatgttctagagatgactctgctctccggaaaaggacactgtcactgacccagcgagggagaaacaagaagggaatattttcttcgttaaaagggctggacacactggccagaaaaggcaaggagaagagaccttctataactcaggtcgatgaacttctgcatatatatggttcaacagtagacggtgttccccgagacaatgcatgggaaatccagacttatgtccactttcaggacaatcacggagttactgtagggatcaagccagagcacagagtagaagatattttgactttggcatgcaagatgaggcagttggaacccagccattatggcctacagcttcgaaaattagtagatgacaatgttgagtattgcatccctgcaccatatgaatatatgcaacaacaggtttatgatgaaatagaagtctttccactaaatgtttatgacgtgcagctcacgaagactgggagtgtgtgtgactttgggtttgcagttacagcgcaggtggatgagcgtcagcatctcagccggatatttataagcgacgttcttcccgatggcctggcgtatggggaagggctgagaaagggcaatgagatcatgaccttaaatggggaagctgtgtctgatcttgaccttaagcagatggaggccctgttttctgagaagagcgtcggactcactctgattgcccggcctccggacacaaaagcaaccctgtgtacatcctggtcagacagtgacctgttctccagggaccagaagagtctgctgccccctcctaaccagtcccaactgctggaggaattcctggataactttaaaaagaatacagccaatgatttcagcaacgtccctgatatcacaacaggtctgaaaaggagtcagacagatggcactctggatcaggtttcccacagggagaaaatggagcagacattcaggagtgctgagcagatcactgcactgtgcaggagttttaacgacagtcaggccaacggcatggaaggaccgcgggagaatcaggatcctcctccgaggtctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacggaagcactaaaggcaatggagaaagtagcgagccacatcaatgagatgcagaagatctatgaggattatgggaccgtgtttgaccagctagtagctgagcagagcggaacagagaaggagcagcccgaatggagctcagaggtgatggatgtactagatcccaggggaaagcttacaaaaggcactctggaagaaccacggacactggtaacagaactttcgatgggagagcttctgatgcactctacggtttcctggttgaatccatttctgtctctaggaaaagctagaaaggaccttgagctcacagtatttgtttttaagagagccgtcatactggtttataaagaaaactgcaaactgaaaaagaaattgccctcgaattcccggcctgcacacaactctactgacttggacccatttaaattccgctggttgatccccatctccgcgcttcaagtcagactggggaatccagcagggacagaaaataattccatatgggaactgatccatacgaagtcagaaatagaaggacggccagaaaccatctttcagttgtgttgcagtgacagtgaaagcaaaaccaacattgttaaggtgattcgttctattctgagggagaacttcaggcgtcacataaagtgtgaattaccactggagaaaacgtgtaaggatcgcctggtacctcttaagaaccgagttcctgtttcggccaaattagcttcatccaggtctttaaaagtcctgaagaattcctccagcaacgagtggaccggtgagactggcaagggaaccttgctggactctgacgagggcagcttgagcagcggcacccagagcagcggctgccccacggctgagggcaggcaggactccaagagcacttctcccgggaaatacccacaccccggcttggcagattttgccgacaatctcatcaaagagagtgacatcctgagcgatgaagatgatgaccaccgtcagactgtgaagcagggcagccctactaaagacatcgaaattcagttccagagactgaggatttccgaggacccagacgttcaccccgaggctgagcagcagcctggcccggagtcgggtgagggtcagaaaggaggagagcagcccaaactggtccgggggcacttctgccccattaaacgaaaagccaacagcaccaagagggacagaggaactttgctcaaggcgcagatccgtcaccagtcccttgacagtcagtctgaaaatgccaccatcgacctaaattctgttctagagcgagaattcagtgtccagagtttaacatctgttgtcagtgaggagtgtttttatgaaacagagagccacggaaaatcatagtatgattcaatccagatatgggttaaattcctcattttacttttaaactggtggtaaagtggaaattgcaaaaaaaaaaaaaaaaaaaaactgttcattcctgggttttgtgcagtatacattttcccacaaaatggttgtaaagatttaagttattttaatttattgtggatcagaaacctagatgaaactggtcagaatctgtaaattacttagtttatatccactttgagcaggtatcaaatgatttaggatccttaaaattacattctaataattaagttatgtggaaaaagtaaggctggggaagtcgtgattaatagttttcaaagggccattttttaaaatcctctgggcattttctttcagctgtttgttagtttttgctttatttaaagcatatttaagttattttaatgtggtttaggggcaaaatgtgcagatacttcatttttgtaagatagattgtaatagatgctgtttatactaaacatgtcataactatctatacagtatatattaaaagaaagcttgtactgtatcttatttgatgatatttattttctctgccaagctgtatagtaaaaggaaaataagtcaca

SEQ ID NO: 3639 - DNA, 357 bp, Homo sapiens
cctgcatttagatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaa

SEQ ID NO: 3640 - DNA, 866 bp, Homo sapiens
agcgcaccgcgggaagatggcgttggaggtcggcgatatggaagatgggcagctttccgactcggattccgacatgacggtcgcacccagcgacaggccgctgcaattgccaaaagtgctaggtggcgacagtgctatgagggccttccagaacacggcaactgcatgtgcaccagtatcacattatcgagctgttgaaagtgtggattcaagtgaagaaagtttttctgattcagatgatgatagctgtctttggaaacgcaaacgacagaaatgttttaaccctcctcccaaaccagagccttttcagtttggccagagcagtcagaaaccacctgttgctggaggaaagaagattaacaacatatggggtgctgtgctgcagaaacttaggaaggaatctcaagagcatacaaaagatctagacaaggaactagatgaatatatgcatggtggcaaaaaaatgggatcaaaggaagaggaaaatgggcaaggtcatctcaaaaggaaacgacctgtcaaagacaggctagggaacagaccagaaatgaactataaaggtcgatacgagatcacagcggaagattctcaagagaaagtggctgatgaaatttcattcaggttacaggaaccaaagaaagacctgatagcccgagtagtgaggaacaaattaaggacattttctacattgaaaaccaaaaggaatatgaaaataaaaaagctgctaggaagaggagaacacaagtgttggggaaaaagatgaaacaagctattaaaagtctaaattttcaagaagatgatgatacatcacgagaaacttttgcaagtgacacgaatgaggccttggcctctcttgatgagtcaca

SEQ ID NO: 3641 - DNA, 569 bp, Homo sapiens
agctgcgacgccgagtttcactctggctgccttctcctgagagtcggagccacagccagagccctgcccaggccgagccggagctgcagcccgagcgcggtggtgccctcagccccgtcctcttgtcctcctcagcctcgtccccaggcacagcacacggatccaacatctgtacctttgtttttactaactgctgtttcttaatttaaaacctgatcatcttcttcctcgttggcaaaggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcag

SEQ ID NO: 3642 - DNA, 574 bp, Homo sapiens
tttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtagagcgagaataggacagactcgtataccattctgatctgggtgcatttcttcagaagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccg

SEQ ID NO: 3643 - DNA, 691 bp, Homo sapiens
gtacgggagctggaggctgagcttgatgcagagcagaagaagcacgccgaggcccttaagggcgtgcgcaagcatgagcgccgtgtcaaggagctcgcataccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaaggtgaggagtggcaggggcattgctctctgtgcagggggactgtgggggctgacaggtagtactgctcactcagctatccctttctcctcagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctcca

SEQ ID NO: 3644 - DNA, 609 bp, Homo sapiens
tccaacgtcatggaggctaatgccgctcgccaggccactcctgcagagtggagtcaagatgactccaatgatatgtgggaggaccaggaggaggaagaggaggaggaggaggatggtttagctggccaacttttatctgacattcttgctacaagtaaatatgaggaggattactacgaggatgatgaggaagatgaccctgatgccctgaaggatcctctctatcagattgatctgcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaagga

SEQ ID NO: 3645 - DNA, 3250 bp, Homo sapiens; identical to SEQ ID NO: 3151

SEQ ID NO: 3646 - DNA, 2309 bp, Homo sapiens
cgcagacgggaagctgctcagcaccggcttcagcaggatgagtgagcggcaactcgcgctctgggacccggtaggccaggccgcgccgggcgcgctagctcgctccttctctgggtctgccgggagcgccttcccgggctgtggctggcgcccaagaggccagagcggagcggggagctcccattcgggaaaagcctcgctgcgactccggggagccagcagacacccctgctctagggatcggcctttgagcgcgcttaagggttcgggatcggctgagagccgcgtgcctcctgctctctccaggcccggatgctctccaggtcaggggccagacgtggccccgcaggaagctgagtgcttaggccccatttgtctcttccccgcatccgctcctccaccccggacacccaagtcagcaagctggttgctcatccctccatgctcctcagggcaggcagctgggtgatgtccctccctgtctccccctccccccaggagaggtttgcggcccacgaggggatgaggcccatgcgggccgtcttcacgcgccagggccatatcttcaccacgggcttcacccgcatgagccagcgagagctgggcctgtgggacccggtaacgcagctggaggcttgggttttgctgcgtcgcgtgaaggatcctgcgctggcgcccccacctggtgatgccgagtccctgggggtggtttgctgtgactgcatgcggcgcgcagcggaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggtccatcaggcagcctcttaccctagagctctctccactctgaggttcagaaggaccccaacccacaccgtaggcgttccccccaagtaaagttaggtagcaaaagcctccggt

SEQ ID NO: 3647 - DNA, 955 bp, Homo sapiens
gacggcggtcgcgtcggcgtcagggtcggggtcggtaaggggtgcggcaatgctgcaactgcgggactcggtggactcggccggtacgagccccacggcggtgctggcggccggcgaggagcccggcagcatcgagcaggcagtggaggagatccgcgtggtggtgcggcccgtggaggacggcgagatccagggagtgtggctgcttaccgaggtggatcactggaacaatgagaaggagcggctggtgctggtcacggagcagtccctgcttatctgtaaatacgacttcatcagtctccagtgccagcaggtggtgcggatagcgctcaacgcagtagacaccatttcctacggagaattccagtttccccctaaatcgctcaacaagcgagaaggttttgggattcgaattcagtgggacaagcaaagtcgtccttccttcataaacagatggaatccctggtctaccaacgtgccctatgccactttcacagaacacccgatggctggcgcagatgagaagacagcatctctgtgtcagttggaaagcttcaaggctctgttaatccaagctgtcaaaaaagcccaaaaagaaagccctttgccaggacaggcgaatggcgtgctgatcctggagcgccccctgctcatcgagacctacgtgggactcatgtccttcattaacaacgaggcgaaactgggctactccatgaccaggggcaaaataggcttttagccgctgctgctggaaggatggggatctttcacctttagggatctcagcacaattagaatcgtaaagtgaattctatctatttaattggatattggactctgctcatataagctacagacaaaagccaaaagactctcgctgtccctgtgctgctggtatttcattctctgtaacttcagttctggtgttttccttgagtatctacttggcttctcg

SEQ ID NO: 3648 - DNA, 643 bp, Homo sapiens
ttaaccacttaacctctcagaactgaacaaagacaacattgttcctggaacgccctctttttaaaaaagctttttccccttcagcatttatccatgagacaatcaccaagatgacccagggattgtactgcgttgcaggcttctgccatttgaccttcctgcctgccagggttttgagttcatgctgttgtttgtacttaaatgagtagcctgatggactgcagaacatataataaaggagacccctgatgtcctgatgtgtgaagtgtcaagggggtggaagccgtgcactgagggaatcctaaaagtaagacctacaagaaaaatcagctatgaaggcaacataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggag

SEQ ID NO: 3649 - DNA, 3275 bp, Homo sapiens
agcttgtcccacagcgagctgtggagctgggagggccattcagagctctgcatggaggcagggtggccggccttcgtcccctcaggccagcagggcaaggcagctcccctcaatagagatccagcaatgggagcagaatcttgagaaatttcacatggatctgttcaggatgcgctgctatctggccagcctacaaggtggggagttaccgaacccaaagagtctccttgcagccgccagccgcccctccaagctggccctcggcaggctgggcatcttgtctgtttcctctttccatgctctggtatgttctagagatgactctgctctccggaaaaggacactgtcactgacccagcgagggagaaacaagaagggaatattttcttcgttaaaagggctggacacactggccagaaaaggcaaggagaagagaccttctataactcaggtcgatgaacttctgcatatatatggttcaacagtagacggtgttccccgagacaatgcatgggaaatccagacttatgtccactttcaggacaatcacggagttactgtagggatcaagccagagcacagagtagaagatattttgactttggcatgcaagatgaggcagttggaacccagccattatggcctacagcttcgaaaattagtagatgacaatgttgagtattgcatccctgcaccatatgaatatatgcaacaacaggtttatgatgaaatagaagtctttccactaaatgtttatgacgtgcagctcacgaagactgggagtgtgtgtgactttgggtttgcagttacagcgcaggtggatgagcgtcagcatctcagccggatatttataagcgacgttcttcccgatggcctggcgtatggggaagggctgagaaagggcaatgagatcatgaccttaaatggggaagctgtgtctgatcttgaccttaagcagatggaggccctgttttctgagaagagcgtcggactcactctgattgcccggcctccggacacaaaagcaaccctgtgtacatcctggtcagacagtgacctgttctccagggaccagaagagtctgctgccccctcctaaccagtcccaactgctggaggaattcctggataactttaaaaagaatacagccaatgatttcagcaacgtccctgatatcacaacaggtctgaaaaggagtcagacagatggcactctggatcaggtttcccacagggagaaaatggagcagacattcaggagtgctgagcagatcactgcactgtgcaggagttttaacgacagtcaggccaacggcatggaaggaccgcgggagaatcaggatcctcctccgaggtctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacggaagcactaaaggcaatggagaaagtagcgagccacatcaatgagatgcagaagatctatgaggattatgggaccgtgtttgaccagctagtagctgagcagagcggaacagagaaggaggtaacagaactttcgatgggagagcttctgatgcactctacggtttcctggttgaatccatttctgtctctaggaaaagctagaaaggaccttgagctcacagtatttgtttttaagagagccgtcatactggtttataaagaaaactgcaaactgaaaaagaaattgccctcgaattcccggcctgcacacaactctactgacttggacccatttaaattccgctggttgatccccatctccgcgcttcaagtcagactggggaatccagcagggacagaaaataattccatatgggaactgatccatacgaagtcagaaatagaaggacggccagaaaccatctttcagttgtgttgcagtgacagtgaaagcaaaaccaacattgttaaggtgattcgttctattctgagggagaacttcaggcgtcacataaagtgtgaattaccactggagaaaacgtgtaaggatcgcctggtacctcttaagaaccgagttcctgtttcggccaaattagcttcatccaggtctttaaaagtcctgaagaattcctccagcaacgagtggaccggtgagactggcaagggaaccttgctggactctgacgagggcagcttgagcagcggcacccagagcagcggctgccccacggctgagggcaggcaggactccaagagcacttctcccgggaaatacccacaccccggcttggcagattttgccgacaatctcatcaaagagagtgacatcctgagcgatgaagatgatgaccaccgtcagactgtgaagcagggcagccctactaaagacatcgaaattcagttccagagactgaggatttccgaggacccagacgttcaccccgaggctgagcagcagcctggcccggagtcgggtgagggtcagaaaggaggagagcagcccaaactggtccgggggcacttctgccccattaaacgaaaagccaacagcaccaagagggacagaggaactttgctcaaggcgcagatccgtcaccagtcccttgacagtcagtctgaaaatgccaccatcgacctaaattctgttctagagcgagaattcagtgtccagagtttaacatctgttgtcagtgaggagtgtttttatgaaacagagagccacggaaaatcatagtatgattcaatccagatatgggttaaattcctcattttacttttaaactggtggtaaagtggaaattgcaaaaaaaaaa

SEQ ID NO: 3650 - DNA, 1241 bp, Homo sapiens
gtcaaaggggcggcccggcccggcccggaagctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagagcaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccc

SEQ ID NO: 3651 - DNA, 2011 bp, Homo sapiens
cttttcctgcccacgtggtctcgggctcctgccccgtcctgctcacgagttcagggctcctgggcggccgccttttccagttccaggtgtgcagaagtgtcctctccccacgcgcggcgggctgcacttggtcgctggctccgagatcgcgcggggccgccggaagcccaagacggtaccgggggccgcagccgcagccggcgccgccctccgccctccccaacagcaggccgagtcccgtagcatccggtagggaaatggtcgtgctttcggtccccgccgaagtcaccgtgatcctgttagatatcgaaggtaccacaaccccgattgctttcgtgaaggacattttatttccttacatcgaagaaaatgttaaagagtatctgcagacacattgggaagaagaggagtgccagcaggatgtcagtcttttgaggaaacaggctgaagaggacgcccacctggatggggctgttcctatccctgcagcatctgggaatggagtggatgatctgcaacagatgatccaggccgtggtagataatgtgtgctggcagatgtccctggatcgaaagaccactgcactcaaacagctgcagggccacatgtggagggcggcattcacagctgggcgcatgaaagcagagttctttgcagatgtagttccagcagtcaggaagtggagagaggccggaatgaaggtgtacatctattcctcagggagtgtggaggcacagaaactgttattcgggcattctacggagggagatattcttgagcttgttgatggtcactttgataccaagattggacacaaagtagagagtgaaagttacaaagattgcagacagcattgggtgctcaaccaacaacattttgtttctgacagatgttactcgagaggccagtgctgctgaggaagcagatgtgcacgtagctgtggtggtgagaccaggcaacgcaggattaacagatgatgagaagacttactacagcctcatcacatccttcagtgaactatacctgccttcctcaacctagagaagggttgttaaggcagaccgccctgttccccagagttgtccctgtagtgtctaggtttattctaatggtaaaagtaacttacttaaaaaacatatgtacacatatgtatgcaagtatgtatatatgtgtatgctcagattaacttccataggtacataagtgaaagaagtctcagttcagtgaacacaaaacttatttaaagatgctttatatgtagaaattgtttcaaatcatactctaacccttagtgagggcaaagtgtagttggtagaagaaattgctaaatacctatctaatgtgctatgtttatcaaatcgtgtactaaaatggaaagctagttttgagaaattattcagaagccttgttattttaaaaatgaaatatttcaaagactgaatattttcaaagaaaatgaataattcattgcccttgtgatttagaagattataacagctgtatttcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagttgccttaccagtgaaaaaggtgcactgaggtaacatctaaaacagagatgtggttcttaatgtttaacagaacagttctaatcctgccacgtgttatcattatagattttatagttgcctttctaactacttagcacagtttgagaatacgttaattgctatttactatttaaaaagttttactgaaatcagtccataacattaagatgagccctaatatgtaagattttcctctggaatggatgtgagaaatgtaaattttataacagcagtatttatcctggtttaattctaatacgatgtcatgttaatttcatgttgtgattaataaaagcattttttcttcactc

SEQ ID NO: 3652 - DNA, 3549 bp, Homo sapiens
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtggtgagtatagacctggcccatgggggcagctgcaccgtgggcgtggtgagcgaggatgtgcagcggaagggggagcttcggctgcggccagaggagggggtgtgggctgtgaggctggcttggggcttcgtctcggctctgggctccttccccacacggctgaccctgaaggagcagccccggcaggtgagggtgtctcttgactatgaggtgggctgggtgaccttcaccaacgctgtcacccgagagcccatctacaccttcactgcctccttcactaggaaggtcattcccttctttgggctctggggccgagggtccagtttctccctgagctcctgagaaggagcagttacctactctcctctaagtacaggactcatatcaacccaagtaccatgtggacttgatccctggctgaatcacctggatgacttggaatagaaatgactgctttagaagatgggatggggccgggtggtaagggatagaagagaggactctcaatctactgatcaagtcctttccccaatgcccagtggatggccagggtacctggggactcaggctgctgccagttctgctcaccaccatccgtgcttggcacagaagtagctgcatagaaagagcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatgtagagaaaaaaaaaacctgctctatatctgaaagagctcttgggaagacagagaaacataaagaggaaattatagcacagtgtggtgggtgttacgggaagtccaaccccagcattatgggagttcaggggaaggggcatagcccagcctggaaggagaggatgagtgggggatggctttctgaaaagggtagtctaaaggatgcctatagtcaatagggaaaagaggggaagaagcatcttaagaagaggaaacagcagagaactggctggatgacctgtgactctggagcactgggttgtctccattgtccttatgggcagatgtgtgccatccccagccgacaccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgacctttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagatgtaaaatacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattaaagattgaattgctttccctgggagtgtgcagtatctcattaaaatgttgtatattcaaaaaaatacagacacacacaagtgcctatataatgataaaacatatgcaaagcacccaaacctgtgattccagaaaggtagatcctatttttctgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 3653 - DNA, 4082 bp, Homo sapiens
attaggcctgccgagaggagtgttttcttgcatccagaaaagacctgagaggcggacgacacctgtgctccgcagagcagaacgtgggaggaacggcgggatgttaaggtaggagctcaagaagcagagagtctacctgcccgacgcgttcgtggagaggagcagcggttgctgttggaggaggtgggtgcaaggacggcagatggcatccctgagaggtggtgactgagactagatgcgggtgcaggtctgtttctttctaggttcctgtagagatctgtatgtagctgttcacttggaagttaattaagaaagaacaaaaactattcatttggattcaaggtccatctccactggtggctgtggtggctttggattgttggaagaccatcaccttcagcaggtctgcacttgggaacaatcattctcccccagcccgagcgtgcctctgccctctgtatcattgacagaggctgtatgtttggaaagagaactttgtgactgcagaactgacagttgactctaattcttgctaccaagtttttccccgacccagtgaaagagtgttaagacttcgacctaggacacattgagaaccaaggccaagactggacagggccatataactgggcttcaaccatggctgggactaagaataagacaagagcccaggccaaaactgaaaaaaaggctgctatacaagctaaagctggagcagagagggaggctactggtgttgttaggcctgtagccaagaccagggccaaagcaaaagccaagacagggtctaagacagatgcagtagcagagatgaaggcagtgtctaagaacaaggttgttgctgagacgaaggaaggagctctgtcagagcctaagactctgggcaaagccatgggagatttcactcccaaggctgggaatgagtccaccagctccacatgtaaaaatgaggctggtactgatgcctggttctgggctggggaagaggccactatcaattcctggttctggaatggagaagaggctggtaatagtttcagcactaagaatgataaacctgaaattggtgcccaggtctgtgctgaggagttggaacctgcggctggggccgattgcaaacctaggtcaggggctgaggaggaggaggaagagaatgttattgggaactggttttgggaaggagatgatactagttttgaccctaatcctaaacctgtgagcaggatagttaagcctcagcctgtgtatgaaattaatgaaaaaaataggcccaaggactggtctgaggtaactatctggcccaatgcccctgctgtaactccagctgtgttaggatttagatcccaggcaccatctgaggcaagccctccttcatatattgttctggcctccgctgaagaaaatgcctgttctttgcctgtggcaacagcttgccgcccttctaggaacactcgctcatgctcacagcctatccctgagtgtcgttttgattctgacccctgcatccagaccatagatgagattagacgtcaaatcaggatcagggaggtaaatgggattaagccatttgcttgtccttgcaaaatggaatgctatatggattctgaggaatttgaaaaacttgttagcttacttaagtcaactactgatcctcttattcataaaatagcacggattgcaatgggtgtccataatgttcacccatttgcccaagagtttattaacgaagtaggtgtagtgacacttattgaaagcttgctcagttttccttcccctgaaatgagaaaaaagactgtaattactctgaatcctccttctggggatgaaagacaacgcaaaattgaattacatgttaagcatatgtgtaaagaaaccatgtcatttcctttgaactcaccgggacagcaatctggattaaagatactaggacaactgactactgattttgtccatcactacattgttgccaattacttttcagagcttttccatttgctgtcctcaggaaattgcaaaaccagaaatcttgttttgaaactacttttaaatatgtctgaaaatccaactgcagccagagacatgatcaatatgaaggcattggcagcattaaaactcatctttaaccagaaagaggcaaaagccaatcttgttagtggtgtggccatatttattaacataaaggagcatatcagaaaaggctcaattgtagttgttgatcacttgagttataatacactcatggccattttcagggaagttaaagagattattgaaacaatgtaaaatgagccagagatagaacattttaagccatcttcaaactctagcaggctgtacattacagtgtacacattatacactgcatctttaacacagagtcacctgtgacaggctctaggtttgagctagactattttgggggtatcaaatgaatattataccttgggctgaaaatgtttgatttttatcttgtctagattggcatatttttaacattttacttaagatagcaaaccagttcgttttaagtaagctaacttgttcattagtatctgtggcttaaaatggcaaaaaagaaaatatccttgagtttgtaatctagttacagaagtaaggcatacacacacacaaagataacagtacctagagagagagtgtgtgtgagtgtgcgtgtctctgtgtgtgcacgtgcacgctcatggccaaatgtgcgcactctacataaaggaggcaggagttcctataggctatttaatgtaagagaaactatttttctcctgttccagctgtatcagatactcgttccgcaacacagaaatgactcagaatctcagacaaaatgtattatttgttcaattttaattttgctactacattcataactcttaaattgttaggctgtttcatttacatcaaagttatctcacaaaagagaaggcaggaaacgttttgtgagtgcctattctatgtcaaacactgtgttggcaccatattttacaagtttttttcctcttctcacagtgatcttgtgagttagttacttatatttttattagaactcattattctgggtaccctccaatgagaattagagaggttaaataccttttcctagattcccacagcaggaaggtggcatagctgttttgtctgacaccagaacccatctcaccacactgctttacagtcttcctgaaggacattttgaggtgggggggccttcaaagctcagagactggtttgaatggtttaattttgcaatggatcatgtccatgccaggtgttacaattcttaacttcctccaaattcgtgtgtccattagacatttggctacatctggctggaggtcaggagaaaattctgaggtaaatagatggattttatctggcagtgtcgaaaatagtaggagcctaaaactttgttcaatgagtaagatgtagatttggagtcatcagcaggggaaacttgttagatgtcctttgtatctttttctatccatttgtattttttctttcccaaagagctgaaatcattttataccctgaatttaaaaggtaattgcttttttcctccttgcgaaatcataccttaattttttttttttttttttttaccatttatgatttattctcctatgtgtcatatgaaaggccaaggggctttatcttttactagtaggcaagcctgggcatttctgcatttgtgccagctaacactacaaaatagacttaattagagaaatttagacccagaattgcagcttcaacaacacaaaacaggaaagctagaagaggttgctgtgtcaacctacaagatagtgattcttggaagttggtatggaccagaaagcattcccaggacatttaggctatggctgagttctctaagactcagggtgggaattataatccctggtctaagctgatatgaaagtttctatgtgtgaaaatatggagttatatgctttgagattttctgccagttaaactaaaacaagatcatactgtaaatgtttgtaacttgcttccccccactgtatactgtaaacatctttgcatgtcaataaatatgcctctacaac

SEQ ID NO: 3654 - DNA, 2393 bp, Homo sapiens
atatctctaggggtttatgacaggctgttttcttttctcagtgtggggatgaattgctccattatcatctaaattggaagtcatgatgatggaaaccaacatgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcagtgagcactcccagtgaagctggaagccaagactcaggcgatctggggccattaacaaggaccctgcagtgggacacagacccctcagtgctccagctgcagtcagactcagaacttggaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggttccaacagcaagtgtggccattgagggggcatccgccctaaaccgtgttcgttgggcccaagctggcaaagaagttgctgttggggactcggaaggccgtatttgggtctatgacgttggagagcttgcagttccccacaatgatgaatggacccgatttgccaggacccttgtggaaattcgtgctaacagagctgatagcgaggaggaaggcactgttgagttatctgcctagtggaaatgagccacccccactgcagcccccacctttgtgtcctagagctcagcgtctgcagtcaagtctcttgtattcggtgtccattcagtatcagtattgctgtgatattttgggtgccatattgtgccagctttgctccaagtattctaaatgtgtcccatcatgctttccactgacccaaaattcaccacagcatttctatctttatatttctgtctcaaaaatgaagagaagggggttatgggttaagttgctgccttttaactactttgtagctgtatttaatagctggaaacctctggttaaatttgtgcttacatgcactcctggcatagtcctattaaatccatatgaagccagatatgattgggtgcagatgtggtgttcctcatattatggtaca

SEQ ID NO: 3655 - DNA, 776 bp, Homo sapiens
tgtcctcccagctaccccctccctaagcaggctgaggaagaagagatagcaagccctcacctaacttgacccctttcttgtctctccccgctgctagcttctcccttctcgctgccttgcggggtggggaaacgtggaaggaattctgggaaaaccagatgtctgggttctctattcccgtctggcttgattctggacaaggggcttcctctccagggcctcggtttccccatctttaaaatggactgatagcatagacctgcccacctttcagaggtgcccgaagccttgacgagataacagatgagaagtggttttcgttgtgatgagccagctgaagcggttgcaccggagcgccagaccgtcagcggtgcagtggctctcgcgtccttcacatccccccacacccatcccgtggatgatgggggaaggcactactcctggggttccccgaagcggatcctgggactgggacctggggacgcggccaaggaggcgggtttggtgcggccactccaaggccaaagcgagaaaatcttactgcgcacgcgcaatagacagccgatggagccaccgatggagccgtccggaggggagcaagagcccggagccgtcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgag

SEQ ID NO: 3656 - DNA, 1456 bp, Homo sapiens; identical to SEQ ID NO: 1946

SEQ ID NO: 3657 - DNA, 555 bp, Homo sapiens
cttctctcttcctcggcgctgcctacggaggtggcagccatctccttctcgctggcgattggaagacactctgcgacagtgttcagtccctgggcaggaaagcctccttccaggattcttcctcacctggggccgcttcttccccaaaaggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaa

SEQ ID NO: 3658 - DNA, 793 bp, Homo sapiens
ggtggcgtccgggactctccctgcaggtgactgacggcgccggccgcccctgcccgtcgcccgcccgctgctgccgcccgcccggggtgtggagcccggccgctgctcgcgggctgagtgtctgtcgctgctgccgcctccacccagcctccgccatggacctcttcggggacctgccggagcccgagcgctcgccgcgcccggctgccgggaaagaagctcagaaaggacccctgctctttgatgacctccctccggccagcagtactgactcaggatcagggggacctttgctttttgatgatctcccacccgctagcagtggcgattcaggttctcttgccacatcaatatcccagatggtaaagactgaagggaaaggagcaaagagaaaaacctccgaggaagagaagaatggcagtgaagagcttgtggaaaagaaagtttcctcttcggtgatctttggtctgaagggctatgtggctgagcggaagggtgagagggaggagatgcaggatgcccacgtcatcctgaacgacatcaccgaggagtgtaggcccccatcgtccctcattactcgggtttcatattttgctgtttttgatggacatggaggaattcgagcctcaaaatttgctgcacagaatttgcatcaaaacttaatcagaaaatttcctaaaggagatgtaatcagtgtagagaaaaccgtgaagagatgccttttggacactttcaagcatactgatgaagagttccttaaacaagcttccagccagaagcctgcctggaaaga

SEQ ID NO: 3659 - DNA, 1567 bp, Homo sapiens
aggcgcaagaagcaaccagccgcgctatccgctcccgttgctaccggaatgcctcttcaggttagcgattacagctggcagcagacgaagactgcggtctttctgtctctgcccctcaaaggcgtgtgcgtcagagacacggacgtgttctgcacggaaaactatctgaaggtcaactttcctccatttttatttgaggcatttctttatgctcccatagacgatgagagcagcaaagcaaagattgggaatgacaccattgtcttcaccttgtataaaaaagaagcggccatgtgggagaccctttctgtgacgggtgttgacaaagagatgatgcaaagaattagagaaaaatctattttacaagcacaagagagagcaaaagaagctacagaagcaaaagctgcagcaaagcgggaagatcaaaaatacgcactaagtgtcatgatgaagattgaagaagaagagaggaaaaaaatagaagatatgaaagaaaatgaacggataaaagccactaaagcattggaagcctggaaagaatatcaaagaaaagctgaggagcaaaaaaaaattcagagagaagagaaattatgtcaaaaagaaaagcaaattaaagaagaaagaaaaaaaataaaatataagagtcttactagaaatttggcatctagaaatcttgctccaaaagggagaaattcagaaaatatatttactgagaagttaaaggaagacagtattcctgctcctcgctctgttggcagtattaaaatcaactttacccctcgagtattcccaacagctcttcgtgaatcacaagtagcagaagaggaggagtggctacacaaacaagctgaggcacgaagagcaatgaatactgacatagctgaactttgcgatttaaaagaagaagaaaagaacccagaatggttgaaggataaaggaaacaaattgtttgcaacggaaaactatttggcagctatcaatgcatataatttagccataagactaaataataagatgccactattgtatttgaaccgggctgcttgccacctaaaactaaaaaacttacacaaggctattgaagattcttctaaggcctacaggattatgaagcggcacttaagattgatccatccaacaaaattgtacaaattgatgctgagaagattcggaatgtaattcaaggaacagaactaaaatcttaatgactattagaagtaactaagtattgttataagttttttaaaaacaactggaggcatctttgtacatattatggccagttgtacagaatcgctttctgtttagtactttagttctgttgagggcaaaatattataaatctatagaaaataaactgtttgacttgaatcatttctgaataagtaaatctaaataagaatctattttaattccttatttcttcatattaatacatatgtatacttttttgtgttactgaattaagcttgcccttgtaacaaaatatgttttggtatagttaccaggacacttactgattaatttttaacaaggtagaattttaaaataaaagatttataaataa

SEQ ID NO: 3660 - DNA, 2078 bp, Homo sapiens
aagccctagagaggctaccaccggtacaccccgccttcccacccacgggtaaagtggcgccgcctacgcaccggcacagcccctgggctcccgccccggcgcggagaccaccgtggacatccgggggcgggaggccgctctggccccaagcggagcctctctctggtagacgagcccgagggagcccttctgggcgcggcgccgcggagctgctctatgctccaaccggaagtgctcttcaccgccggcctcccacccagctctctggtcccggcggtaagatggcggctgccgcggagtgcgatgtggtaatggcggcgaccgagccggagctgctcgacgaccaagaggcgaagagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgattttgatccaaacaatatcttcaaggcattctttggcggtcctggcggcttcagctttgaagcatctggtccagggaatttcttttttcaatttggctaatgaagggcaaccacccagaacccagaaaatgcagattcactcagtttaatcttgaatgtggaaacagttcacctcctcccttcatcacgtctccgtgtgcttagagcagtttcgttttctcagttggatgccctgtgtctctgtgagtggggtggagcaaagggaaccaatgccgaagaccgagggcaggggagggaggcgggggtggacagggaggcagcttgtgaatttttgttttactgtttaactttattaaaaaagaaaaaaaaaagagaataaaatgttttgacccttcctggccctttgctctgg

SEQ ID NO: 3661 - DNA, 1669 bp, Homo sapiens
aacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgagggcgaccacaatcacgacactggggagggtggccagggtggagaggagccccgggggggcaggtgggatgaggatgagcagtggtcggtggtggtggagtgcgaggactgtgagctgatcccggcggaccatgtgattgtgaccgtgtcgctaggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacagagagctcaaagacagcgcatggaagctccacaaagcagcagcctggtcaccttttctcttccaagtgcccagaacagcccctggatgctaacaggggcgccgtaaagcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcccctcagcttctctctggttttctca

SEQ ID NO: 3662 - DNA, 573 bp, Homo sapiens
agaacagtagcaccacccagcagctgggattctttccctctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtaggtaaacacggtgttccagaatacagcaggagcatctgggcatttttgtggctggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagagg

SEQ ID NO: 3663 - DNA, 1472 bp, Homo sapiens
atgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggcacaggctccctgtgggagtgcacacctgtaatcacagctactcaggaggctgcggcaagagaatcacttgaacccgggaggcagaggttacagcgagacaagattgcaccactggactccagcctgggcggcggaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaag

SEQ ID NO: 3664 - DNA, 769 bp, Homo sapiens
aggggaaggcccagaggaagatcagtgccatccacatcctcgatgtccttgtgctgaatggcaccgacgttcgggagcagcactttaaccagcgaattcagcttgccgagaaatttgtgaaagccgtttccaagcctagtcggcccgacatgaatcccatcagggtgaaggaggtgtacagactggaagagatggagaagatttttgtcaggttggagatgaagatcatcaagggctccagtggcaccccaaagctcagctacacagggcgtgatgaccggcactttgtacccatgggcctctacatcgtcaggacagtgaatgagccctggactatgggattcagcaaaagcttcaagaagaagttcttctacaacaagaaaaccaaggactctacttttgacctccctgcagactccattgccccatttcacctccccagccttgcctgcctgtcgaagatggattaactccgcactcccctgggatcgccacatgaccacttcaagtccccaagccgcccttcgctgcacagactgcatttttttctgccataattacaagcaatggcactgactggagggcatgacagtgtgtggtggggggatggacaggtggcacaatgtctgctgctcaaccccagcagtgcccgagccctggaagtaactcccactatttggcttggaaagtgcttcccactgtctccttcccactcgagctgggggccttctcctctattctgaattgtaatccagagctttcccttgaa

SEQ ID NO: 3665 - DNA, 3290 bp, Homo sapiens
ggagcacagagaagctcccagctttgaaggtcttgcggtggtgcgtggcgggcaggaacccacaattccaaatacaaacggtcggcgcgagaagcgcttctgggcgcaggcgcctggctgtagcgactggttgcgggaggctggactctggtgactgtaagcatcaagtgtacctgatttgtgaacctatcttgcttcagttggtttcctcctaaatattaggcagatgggattggctggtctgtgctctgctaggtgaaaaattagacgatttcaagaattggagctgaatctgatgttaagtaatggcaacaggtgacttaaaaagaagcttacggaacctagaacaggtgctccgcttgctaaattatcctgaagaggtggactgtgtaggtttgataaagggagacccagcagcatctttgcccatcatcagctattcttttacctcatactcaccttatgtaacagaacttataatggaatccaatgtagagctcatagcaaaaaatgacttgcgctttatagatgctgtctataagcttcttcgtgatcaatttaattataaaccaattttgacaaaaaagcagtttatccaatgtgggtttgcagaatggaaaatccaaattgtttgtgatattttgaattgtgtgatgaaaaagcacaaggaattaagcagtcttcagaagattccatcacaacaaagaaagaaaatcagttctggtaagtcagaacctcctttgggcaatgagaaaatatctgcagaggctgttggcgttgatatcagtggcaggtttatgacctcaggaaagaagaaagctgtggtgattcgtcacttgtataatgaagataatgttgacatttctgaggatacattaagtccaataacagatgttaatgaagcagttgatgtgtctgacttaaatgctactgaaataaagatgcctgaagtaaaggttcctgaaatcaaggctgagcaacaggatgtaaatgttaatcctgagattactgcactacaaactatgcttgctgaatgccaagaaaatcttaagaaactgacttcgatagagaaaaggttagactgtttggaacaaaaaatgaaaggaaaagtgatggtagatgaaaacacctggactaatcttcttagtcgtgtcactcttcttgaaacagaaatgcttttgtctaaaaagaatgatgaatttatagagtttaatgaagttagtgaagactacgcttcttgtagtgacatggaccttctgaatcctcacagaaaaagcgaagtagagaggccagcaagtattcctctgtcctctggctatagtacagcatcatcagattcaactcccagagcctctactgttaattactgtggtttgaatgagatttcagagaattttcctgcatggagtgctacatcctcttgttccagtctcagctggctgctccgtgggcatacttcatacctttcatcacagagctttgcttggcctctctcctgtgtgtaatctctgtttcttggatcctgtgcttaccttttcctgctgtactctgatgtttcagtgaagctcatccacgaagtccagaattctgcctggaaaccagcttcctcctcagctccagctcttttaatgggcatatcaaaactgatgactttttccttcctgctacatgggtaacacttagttgtttgtctaatttctattttccagaaatttctcaaaatgtctgctgatagcccctcactcatatttttcatgtgggtttatagctttcatatttctttattattgtaaatgggggctgtggaaggtgagaaaacacatgctttcttaaaacagaagctctctccttcattaatttaaatatttttatcggctctagaaaatgcataaggttagtacaagatcagtagagagaaagtcaaagattacagaagtgctgaagcagaccattcttcctttcttcccaatgtctattaagatcacacataggtaaactgttacaaatccagaatggtgaaagagtccaacaatggctgagggaagtagaggttaagatatagctcaacagtgaaagtagcagggaaagagctgggcaaggccaagaccatcttttgtaccgttggtacagtaggctaaaggtacggtgttccatattaaatacagcaatatgaagaaaaataaattaagtcccttatacctaagacctctatttctctgttgattacatacacagtggcaatggaaagaagggaaaataatggggatagcatttgctcattctctgaccatgcaacactggcagcattctatacttattctattaactgcatcaaccacatcttataaaacacatttccataggccatatgtaataggccttggctttattcattgcatttattggctccttaaattgacaacatataattgttttcatataattttcatcaaataaaattcactttaatttgtatgaacatatttaaagtggaaagtatcttcccaaatggtccatatcttaaagtgtcagatattttatgggcttcacatctgaactgccagagatctcaggcatagcatgcattaatcacaaccacttactgacctggttcagatacttactcaatacatggggctagacacagagtgtgccttaggctaaagaaaaaattattcaagttgagcatatccataaactctggctcaagcagtgtattttgggggtaataaacacaagtttgttcctagttggagggatatgatgcttaggtttgaacctgttaaccttcctgggtttgagggctagaaaacgtggagacattcctttctaactaacacattttctaatagaaacaatccaccaggatgttgagcccacattttaagagttcttcggaatttactgaaaatggaaaactgattacattgggcacataggacatttatatttatagaaacattttagataagacaagaattttaaaagccagaaatcacttttagtgggcattttcagaaaaatgttgtcaactttttgtaatttttaataggcataaaaaagattgttatattgatattgacagaaattaggtggttaattagagagcgtaaaaggatgaattgctctaacattggtttagaatttttctttatatgattcaattttgtggtctggcaaaggcccaatagtcatttatctagtatgcatacctttccacagctggattttcaaatatgatgataaagttcatatgacagacctattctgaaaataaatatgtcagcagg

SEQ ID NO: 3666 - DNA, 1024 bp, Homo sapiens
agtcacagcagccagctgctgtagaagaggggaggaaacaagccagtgcaaggggagcaaaagagaaaaggagccaggctgggcttcctgatcccacagcatcgcagagctcgggaggcacagctcacagacacaggaaacacaggactgctattctgctctcctgcccacggtgatctggtgccagctggtggaacagtgggtgatggcgtccctgctgcaagaccagctgaccactgatcaggacttgctgctgatgcaggaaggcatgccgatgcgcaaggtgaggtccaaaagctggaagaagctaagatacttcagacttcagaatgacggcatgacagtctggcatgcacggcaggccaggggcagtgccaagcccagcttctcaatctctgatgtggagacaatacgtaatggccatgattccgagttgctgcgtagcctggcagaggagctccccctggagcagggcttcaccattgtcttccatggccgccgctccaacctggacctgatggccaacagtgttgaggaggcccagatatggatgcgagggctccagctgttggtggatcttgtcaccagcatggaccatcaggagcgcctggaccgatggctgagcgattggtttcaacgtggagacaaaaatcaggatggtaagatgagtttccaagaagttcagcggttattgcacctaatgaatgtggaaatggaccaagaatatgccttcagtctttttcaggcagcagacacgtcccagtctggaaccctggaaggagaagaattcgtacagttctataaggcattgactaaacgtgctgaggtgcaggaactgtttgaaagtttttcagctgatgggcagaagctgactctgctggaatttttggatttcctccaagaggagcagaaggagagagactgcacctctgagcttgctctggaactcattgaccgctatgaaccttcagacagtggagcttcggaggaagatcctggtgaaggggaagaagttaacacttga

SEQ ID NO: 3667 - DNA, 671 bp, Homo sapiens
gtttgagcagcattgttagagcctgtggaaaacactttacaactgtgtaactgtcttcatctttacagaggaatagtctacaaaggaagacttgtaacctggagaagagacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtagacattgcttctgcagaaagcagcatttaaatgctgatgcgtgacatagcttcctcattttatttttctgaagtgatctgctggaattccaaacagaagttccatatatacaaatatgtggcttaaatatttctaaatagaagaactattttcaagtaaaataaaggctgaggttttgtattt

SEQ ID NO: 3668 - DNA, 3959 bp, Homo sapiens
agacgcagaggcgaggccgccagtcgaggacgaggaggagataacatcaagatgccgaagactgaggaaactgtgctccagaatgatcccagtgtagcagagaatggggcccctgagcctaaaacaccagggcagagccagaaaagcaagagtttctgtttagatgaccagtctcctgacctgatgtcttttctgtcacagatctgatagagacagttaatgaagtttccaagctgagcatttcacatgaaattgtagtaaaccaagatttctatgtggaagagaccattttgcctccaaacagtgtagaaggcaggtttgcggaggcaatgtacaatgctttttggaaccatctgaaagaacagctattgagtactcctcctgacttcacttgtgcccttgaacttctaaaagatgttaaggagaccttgctatcactgctattaccatggcagaaccgcctaagaaatgagatagaagaagctctggacacagatctcctcaagcaggaagcagaacatggggccctggatgtccctcatctttctaactacattctcaatttgatggctctgctatgtgcaccggttcgagatgaagcgatacagaaactagagaccataagagatccagtgcagttactgaggggcatcctccgtgttctgggcctaatgaaaatggacatggtgaactataccatccagagctttcgaccctacctgcaggaacattccatccagtatgaacaagctaaattccaggaactccttgataaacagcccagtctcctcgattataccacaaaatggctaaccaaagcagccacagacatcactacactatgtccgagttctcctgactcacctagctcctcctgcagcatggcgtgttcacttccaagcggggcaggtaacaattcagagccccccagtccaacaatggtgctataccaaggctacctgaacctcctcctctgggatcttgaaaacgtagaattcccagagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttggagtctctgctacactttcctggaggcctcattctcattgaaaaggagttggcagaactgggctggaagtttctcaatctgatgcatcataatcagcagagtcatttttcacaaaacgaaatctttccagaagatcacgaataagagagatcaaagctaggcagcttgagttgaagtagagctggaagaaggagttttgaggactgtttcaaaaccactggactagatgatctctaaagtggtgacatggacataggataatggttatagacagtccccctcccaacgggaaaaaatgaaagcaagcaaaaagttaccagctccaagccaacttgaaatccaatcaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcggaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgttgta

SEQ ID NO: 3669 - DNA, 633 bp, Homo sapiens
gagtttcactctggctgccttctcctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaagaaacttccaattgaagacactgagctgaaccattccgcccgcccgcccgcccgagggcactccagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagc

SEQ ID NO: 3670 - DNA, 269 bp, Homo sapiens
ctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccagagactctgctcctatcctccccacctccccctaactgagcagcagtcctga

SEQ ID NO: 3671 - DNA, 2954 bp, Homo sapiens
gggtgacgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacgccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagagtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 3672 - DNA, 1321 bp, Homo sapiens
cccagaagatgtccaggctttggtgagcgggaagcttgcacttcggtatgcagggaggcagacagaagcattaaaatgcgtggctcaggctagcaagaacagatcactggcagattttgaaaaggctctgacagattaccgggcagagctccgggatgacccaatcatcagcacacacttggccaagttgtatgataacttactagaacagaatctgatccgagtcattgagcctttttccagagtacagattgaacacatatctagtctcatcaaactctccaaggccgacgtggaaaggaaattatcacagatgattcttgacaagaaatttcatgggattttggaccagggggagggtgtcctgattattttcgatgaacccccagtagataaaacttacgaagctgctctggaaacaattcagaacatgagcaaagtagtggattccctctacaacaaagccaagaaactgacataggtgagtgctggcttcaggaccccagggctgggcagctctgtcttctgcgtgtcgagactgaaaacctcctcctggtgtcctcatggcttcctgattgacactgctctgtcttctcttgcagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttgggagtggggaaattgcttaaaaaaaaagaaaaagaaaaaaaaaaagattattctaaataaaaggaaaaaggcttacactacctaaagctgtgctctctgcctcctgggagagggccgcaaagccaggcaccccgccaaccactgggggtcctaatccacctgctgggcatcacctctcctcctcctcagaattgggtgtttgctgaccatcaaaagcaatgactttttattctgtttgtactgaaccaaaacaaacaactgtgtatagactgctgttttcttttttatttgaaatgaggcattttggtgttctttcccctaccatacggcctgtctgcccttccctccccacattggctccagcagagtagccgaaggtcctgccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggc

SEQ ID NO: 3673 - DNA, 4815 bp, Homo sapiens
cttttctctcgaagggcacccgaagattgtcacgagtccttagactccaactactgcggcagcttccaaatttcctgaaaaccctaagctgggccagcccggcagcccacgcacttccggcctcggacccgccccaaacacccaagcgccccagcgcctcatctctaggtccggaaataaacgaacatctccgattatggttataccagggtcgagggtttccgaatatattcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaaggaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagcccccgctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtcacgttcacgttctcgttcagcatcaagcaacagcagaaaatctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagcctgagcgggggagcccaaagaagtgtgaagctgaagaggcagagccaccagctgccacacagccccaaacctcagagactcagacctctcatctgccagaatcagaaagaattcatcacactgttgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagtttt

SEQ ID NO: 3674 - DNA, 2038 bp, Homo sapiens
gtggggccgccgttgccagagaagccactagccggttactagctgcgcttttgttccacttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgtaccagtgaaagtcatctcagctgcctgaagcaggacattctaaatgaaaagactgaattggaagcaacacttaaggaagcggagttggtaactcattctgtagaattgcttttgccactatttaaggacaccattgaaaagattaattttgaaaatgcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtgatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagagtatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagaacaaaatcaacttgtttgcaaaatgaacagtaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaattt

SEQ ID NO: 3675 - DNA, 1847 bp, Homo sapiens
ggtggagggtggaacgcgggcgcctgaaggagttgttgtctcggcagcgcccgcggagacgtgaagaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagattattggtaattcctattccttttgaatatttcagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaag

SEQ ID NO: 3676 - DNA, 865 bp, Homo sapiens
gggtcccccggcccctgcagggctacttgggcgcagagccgcggagggtctccgttcctagaggtcctcctatcccgggctgcctgagtcctcgccagcatccgccctctcccactcccatccttcctggatccgcctctcggttcccgagggacagtcccgaccgcaaacccacgtagagtaaggaatgtgggacaggcgacagaagtggcatacggtcctgcgttatccctccgtctcgccacaccttgtgtctccatctctccccacttccttccctccgtctgtcatctgtcatccccggtcgctctaagaccaggattccaattcgcctagtgaggaatctcactaggggaatttatcgcgacatcataaattaacgggttcattttgactgaaaaagcgaaggacttttttcaggcagaaaacaagtctcgtctggacgcgtctagtctatttattgtcgcggggaagctgcggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttgga

SEQ ID NO: 3677 - DNA, 1086 bp, Homo sapiens
gccacgcgtgcgcttaggcgccgctgagcgctgactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaag

SEQ ID NO: 3678 - DNA, 649 bp, Homo sapiens
tccactggtgaaagtgcagatctttggcgttcgtctagacacagcacggcaggagaccaactatgtggagaacaatggttttaatccatactgggggcagacactatgtttccgggtgctggtgcctgaacttgccatgctgcgttttgtggtaatggattatgactggaaatcccgaaatgactttattggtcagtacaccctgccttggacctgcatgcaacaaggttaccgccacattcacctgctgtccaaagatggcatcagcctccgcccagcttccatctttgtgtatatctgcatccaggaaggcctggagggggatgagtcctgaggctcaatcccataccgacatctacaactaatctttcccatcaactctgtgtgaaggcaggttgcaactagaaattcagaggggcttggaatagagaaacctaaagaagcatcatcccctccatccccaacttcctcaaagcccaaagccaagggaaggataaatcaaggctcaaggcttccccagcaaagattagggaaagagacttgaccccaggactgtactacgactcttaagagaacactgcacagcactcaaagtcccccactggactgcttcctccttagccccactggtataaatacatctctctcc

SEQ ID NO: 3679 - DNA, 1902 bp, Homo sapiens
aagggcccagagctctggccggcggaccttttccttctggagtttccccggcgggtgccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatgatgcaaatctgcgacacctacaaccagaagcactcgctctttaacgccatgaatcgcttcattggcgccgtgaacaacatggaccagacggtgatggtgcccagcttgctgcgcgacgtgcccctggctgaccccgggttagacaacgatgttggcgtggaggtaggcggcagtggcggctgcctggaggagcgcacgcccccagtccccgactcgggaagcgccaatggcagctttttcgcgccctctcgggacatgtacagccactacgtgcttctcaagtccatccgcaacgacatcgagtggggggtcctgcaccagccgcctccaccggctgggagcgaggagggcagtgcctggaagtccaaggacatcctggtggacctgggccacttggagggtgcggacgccggcgaagaagacctggaacagcagttccactaccacctgcgcgggctgcacactgtgctctcgaaactcacgcgcaaagccaacatcctcactaacagatacaagcaggagatcggcttcggcaattggggccactgaggcgtggcgcccgtggctgcccagcaccttcttcgacccatctcaccctctctcattcctcaaagctttttttttttttcctggctggggggcgggaagggcagactgcaaactggggggctgcgtacgtgcaggaggcgcggtggggctgcgtggaggagggggccacgtgtgagagagaagaaaatggtggccggagatgggagggcccaaggaacctcctgggagggggcctgcattctatgttggtgggaatgggactgggctgacgccctgcattcagcctgtgcctttcctggggtttcttttctgttcttttcggaggagagggcccgagaaggggccataccagggcgcggcgctgggttgccacacttgggaaagcagcccggagctgggtgctggggaaggcggggcgcgtagcctcccgccgccctgcggttgggccggtggaggcccaggcgttgctaggattgcatcagttttcctgtttgcactatttctttttgtaacattggccctgtgtgaagtatttcgaatctcctccttgctctgaaacttcagcgattccattgtgataagcgcacaaacagcactgtctgtcggtaatcggtactactttattaatgattttctgttacactgtatagtagtcctatggcacccccaccccatccctttcgtgccactcccgtccccacccccaccccagtgtgtataagctggcatttcgccagcttgtacgtagcttgccactcagtgaaaataataacattattatgagaaagtggacttaaccgaaatggaaccaactgacattctatcgtgttgtacatagaatgatgaagggttccactgttgttgtatgtcttaaatttatttaaaactttttttaatccagatgtagactatattctaaaaaataaaaaagcaaatgtgtcaactaaattggacaagcgtctggtcctcattaatctgccaatgaatggtttcgtcattaaataaaaatcaatttaattgatttactagc

SEQ ID NO: 3680 - DNA, 1856 bp, Homo sapiens
attactcgcttacgtgagcagaagtagttctggtcgtcgtctaccgtctcgctatagccgtttgagggaagaaggaggaaaattacccgctacaccaaaattgcattgagccaaacttgccaccaagagcccaacaatcaccatgatgctgagcacggaaggcagggaggggttcgtggtgaaggtcaggggcctaccctggtcctgctcagccgatgaagtgatgcgcttcttctctgattgcaagatccaaaatggcacatcaggtattcgtttcatctacaccagagaaggcagaccaagtggtgaagcatttgttgaacttgaatctgaagaggaagtgaaattggctttgaagaaggacagagaaaccatgggacacagatacgttgaagtattcaagtctaacagtgttgaaatggattggatgacactgccagtggactttcaggggcgaagcacaggggaagcctttgtgcagtttgcttcacaggagatagctgagaaggccttaaagaaacacaaggaaagaatagggcacaggtacattgagatcttcaagagtagccgagctgaagttcgaacccactatgatccccctcgaaagctcatggctatgcagcggccaggtccctatgataggccgggggctggcagagggtataatagcattggcagaggagctgggtttgaaaggatgaggcgtggtgcctatggtggagggtatggaggctatgatgactatggtggctataatgatggatatggctttgggtctgatagatttggaagagacctcaattactgtttttcaggaatgtctgatcatagatacggagatggtgggtccagtttccagagcaccacagggcactgtgtacacatgagggggttaccttacagagccactgagaatgatatttataatttcttctcacctcttaatcccatgagagtacatattgaaattggacccgatggcagagttaccggtgaggcagatgttgaatttgctactcatgaagatgctgtggcagctatggcaaaagacaaagctaatatgcaacacagatatgtggagctcttcttaaattctactgcaggaacaagtgggggtgcttacgatcacagctatgtagaactttttttgaattctacagcaggggcaagtggtggcgcttatggtagccaaatgatgggagggatgggcttatccaaccagtctagttatggaggtcctgctagccagcagctgagtggtggttatggaggtggttatggtggtcagagcagtatgagtggatatgaccaagttctgcaggaaaactccagtgactatcagtcaaaccttgcttaggtagagaaggagcactaaatagctactccagatataaaagctgtacatttgtgggagttgaatagaatgggagggatgtttagtatatccagtatgattggtaaatgggaaatataattgattctgatcactcttggtcagcttctctttctttatctttctttctccttttttaagaaaacgagttaagtttaacagttttgcattacaggcttgtgattcatgcttactgtaaagtggaagttgagattattttaaaacttcaagctcagtaattttgaacactgaaacattcatctaggacataataacaaagttcagtattgaccataactgttaaaacaatttttagctttcctcaagttagttatgttgtaggagtgtacctaagcagtaagcgtatttaggttaatgcagtttcacttatgttaaatgttgctcttataccacaaatacattgaaaacttcggatgcatgttgagaaacatgcctttctgta

SEQ ID NO: 3681 - DNA, 4192 bp, Homo sapiens
tttcccttagtaacagcttttaccttctgcctcaattcctctccccgctcgcgcccttcccccgcgcgccgcctccccccgccgccggccgcgtgcgcccccgcccctccccccgcggcgggagcacctccgctcgccacctggggacccgcgccgcgctccccgcccccgcccgcccggcgcccatcccccgcgccctccgctcgctggggttataattgcctctcaccccccggaggggttattttgggggtggttggaggcggtggcggcggcggcgaggaggggaatttccttgtgcctccattcccgggaggggggagcggcgttggaggccaccgtttccagcatcaacaacagcaacttgtgattggcggtgaccggatattcagttgcacatccccacatcaatgcactgccaatgggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaaataatcatactgatatgatggaagtggatggggatgttgaaatccctcctaataaagctgttgtgttgcggggccatgaatctgaagtttttatctgtgcctggaaccctgttagtgatctcctagcatcagggtctggagactcaacagcaagaatatggaatcttagtgagaacagcaccagtggctctacacagttagtacttagacattgtatacgagaaggagggcaagatgttccaagcaacaaggatgtcacatctctagattggaatagtgaaggtacacttctagcaactggttcctatgatgggtttgccagaatatggactaaagatggtaaccttgctagcaccttagggcagcataaaggccctatatttgcattaaaatggaataagaaaggaaatttcatcctaagtgctggagtagacaagactacaattatttgggacgcacatactggtgaagccaagcaacagtttccttttcattcagcaccagcattggatgttgattggcagagcaacaacacctttgcttcttgtagtacagatatgtgcattcatgtctgtaaattaggacaagacagacctattaaaacattccaaggacatacgaatgaagtaaatgctatcaaatgggacccaactggcaatctcttggcctcctgttctgacgacatgactttaaagatatggagtatgaaacaagacaattgtgtccatgatttgcaagcacataataaagaaatttatactatcaaatggagtccaacaggaccagggactaataatccaaatgccaaccttatgttagcaagtgcatcctttgattctactgttaggttatgggatgtagaccgagggatatgcatccataccttgacaaaacaccaagagcctgtgtacagtgtagctttcagtcctgatggcaggtatctggcaagtggttcttttgacaaatgtgtacacatctggaacacgcagacaggtgctctagttcacagctataggggaacaggtggaatatttgaagtttgctggaatgcagcaggagacaaagttggagccagtgcatcagatggttcagtttgtgtattagaccttcggaaatagcgctactagttggaagccatggaccgactatgaatgtgtacatagccaaaatgactgtccctgacccatgtactgctatagtcccacttgaaccatggccagtccactacagccaaatctaaaagaaatatatacatacagtgtatataaacaaaattgcaccctgaagatgacagagttttgtcacagcttgtgaattctgttcaccaagtgctggaatctaatctgctgtgcccctaaaatagcatttagaagttttggatatgaaaaacagaagagagaaaaatatacattataaaagcagaacatacatgtaccagtttttggatactaaatgacagccttgtttctcccctttgaatcagcagacaccatggattatattctttttttcccttcagtagtgagcagtttgtatgtacagagaaaatggacttacaaaaacttgcagcagtagtttgttcttgctttaaaatttcgtttttggtttagattatggatgcatgaagtaagggagtgaatcagtttcttgtttatatttttttcaccttttaaacaaaaaattctttaaaatattttaatgcattcttttgaagaggtagatgtttggtacattttatggctcccagagcatatattcagttggtgcatgttgtggaagggggaattggaaattaaatgaaaacctatgactttggtcatgtcaatctgtaagacacatcagtaaaagggtattatgctctgttggttttgtttttttgttttgctttttttttttttttttcttttttgttttttggtgatgtggcttaaatgcaatagtttcttttttgggacatatttctgccaattaaagactagaagggcacaactttttttttaattaccatagagaagatacattaaaaaaaatcttctgatgttttgtagccataactaaattatggtaaaaatgtgcactattgtgaaaaggagcaacgtagttttgggttttttgttgtttgtttgttttgctttgttttttaagagattaaaatgtttctggataaggattagcttctcgaagtgtccatcattctgtgtagaagcttaaatatgtaatgtaaccaaactccagtattaaaaatctctcatgttgttttctttatacaaagcaagataacggcatataacactgccattacatggcaaaatgtttgctaccttagtttaaaaaacaatctcaaacaaaagacttgcttcaaggtgtttttaaatagcagtgattcagaattttttttaatgaaagtataattgcactaaccttcttcctgctgctctgattctgcatttgtggtacttgtgactacgttttttcaaatatagatagatttaagctgctaatttttttttttttagtaatcactactatatcatgtcttttactctgtttataatatcaagtattttcttaaagatatagatattaaaccttgtgctcatgcaacttagagtaacatatacagacaaatgattgcatgaggccatgtttatatgtgtgactaataaggcttgtcatgattaacataatccaggtatgtcatttctgaagagaatagtcatcaaatttatatctcgaagattttaattaaggaattgcttattgttgagcttagcaaattaataacactatttctgtcactaattattttgaggccttttagtactaaaattttaacctgtgttctaagtagaaactgatttaacccaagtaatgcagctttgattgatttcagcattcgttgctttgctatttttacaaaacagcattgattgaagcaagtcttggttttactaaggtagggtagcatttgctattggtaaagagaataaatacacttaatttcacaatacattgttatatgtaccccagttgttgttagtggggactatgatactgtaataatatttttaaaaatttacatcaagagaggcagtcattcacgatggttttgtgccagctctttttagggttttggatcacattagagatatttagaacatattaccctgtgacttacgtaggaaacctaatatgctgagtatctggcacttgaattcctgcttttattgctggaggtccacatctgtggttgacctctgttattgtttaaaaaaaataaataaaaattaaaaaaa

SEQ ID NO: 3682 - DNA, 3767 bp, Homo sapiens
gttgcctgatgacgagagttgggagtgtggctggggctgcggatctccagcagtggcgttacttctagcggctggataccgggttctccgcgagatcgcgagatcccgagatattctccccgcacggaagcgacgactggcctggccagaggactcgcgtgggagcgaggtgccggccccgacaggacggtgagaaattgttttacagcctacccgtatattacaagaaatctcaagtcaaacactggaaaagatgtcagaagattcagaaaaggaagactattcagacagaacaatcagtgatgaagatgaatcggatgaggatatgttcatgaaatttgtaagtgaagatcttcatcggtgtgcacttttaacagctgactcttttggtgatcccttcttcccccggactacacagatactattagaatatcagctagggagatgggtgccacgtcttcgtgaaccaagggatttatatggtgtctcttcttctggtccattgagcccaacacggtggccataccattgtgaagtcatcgatgaaaaagtccagcatattgattggactccttcttgtcctgagccagtgtatatcccaacgggcttagaaacggaacccctttatccagactccaaggaagctactgtggtttatctagctgaagatgcttacaaagagccctgttttgtgtattcccgagttgggggtaaccgaacacctttgaagcagcctgtggattaccgtgacaatactttgatgtttgaagcaaggtttgagagtggtaatctacagaaggtagtcaaagtggcagaatacgaataccaattgactgtacgccctgacctcttcacaaataaacacacccagtggtactatttccaagtcactaatatgcgagcaggaatagtctacagattcactattgtcaacttcaccaaacctgctagtctttacagtcggggtatgcgcccactgttctattctgaaaaagaggccaaggctcatcacattggctggcagagaataggagaccaaatcaagtattataggaacaacccaggccaagatgggcgccattatttctctcttacatggacatttcaatttccacacaacaaagatacctgctactttgctcattgctatccatacacttacaccaacctgcaagaatacctttctggcatcaataatgatccagtacggtcaaagttttgtaaaatacgtgttttgtgccacacgcttgctaggaacatggtgtatattttaacaatcactacccccttgaagaactctgactcaagaaagcggaaggctgtgattctgactgcaagggtccatccaggggaaaccaacagctcttggatcatgaaaggcttcctagattatattttaggaaactcaagtgatgcacagttgcttcgggacacttttgtcttcaaggtggtacccatgctcaatccagatggtgtgattgtgggaaattatcgctgttccttagctggacgggatttaaaccgtaattatacatctctcctgaaggaatcttttccttctgtatggtatacccggaacatggttcatagactgatggagaaacgagaggttattttatactgtgatcttcatggccatagtaggaaagagaacatcttcatgtatggctgtgatggtagtgacagatctaagacattatacttacagcaacgaatcttcccacttatgctaagcaaaaattgtccagataaattttcattctcagcttgcaagtttaatgtccagaagagcaaagaaggaacaggaagggtggtaatgtggaaaatgggaatcaggaacagctttaccatggaggccaccttctgtggatctactctgggtaacaaacgaggcactcatttcagcacgaaagacctggaatcaatgggatatcatttttgtgattctctcttggattattgtgatcccgaccggaccaagtattatcggtgcctgaaagaattagaagaaatggaaagacatataaccctggaaaaagtctttgaggattcagacacacctgtgatagacattacattggatgtagagtctagtagccgaggctctgacagttcagaatccattgactctctgacttaccttctcaagttaacttctcagaaaaaacatttgaaaacaaagaaggaaaggaattctaccatagcaagccaccaaaatgccagaggacaagaggtttatgatagagggcatttgctgcaaagacacacacaatcaaattctgatgtgaaagatacaaggccaaatgaaccagatgattatatggttgattatttcagaagacaattacctaatcaaggtttggctcactgcaagctccgcctcccaggttcacgccattctcctgcctcagcctcccgagtagctggaactacaggcacccgccaccatacctggctaatttttgtatttttagtagagatggggaaaaaaattcccctcaagggaactgatttgtatggaaactgtttcaaagtgacatccctgcagtctcctatgggcaaacaaacttctacttggactgagaagacaaggataccaacagaagatctgcaccacaacttaaaaagcaaaataaaagaatgcatatctttccaaagcaagaagactggcataaattggacagatgatgaaaaaagaagctacaaggataaaggaatagttcaaactcaagaaatattgcagtatttgctccccatcgtgcatagcactaaaaacatgcaaaccactcagataaaacagctattcaatccaagaaccaacttccaaatccaacatcaactaaatccggctacttgcagaaatataaagaaatacagcacatcttggacagcacccagaaatcacccttttgtaatccaaggggatgttatggcaaactcttcagaatgggtccagtctaagccccacaggtcattggaaagtttatcacctctcaaaggccccaagaagaataaacattctcaaatctgggccataaagaatgaagacataaaacctctcagcagcaagtgggagactgcttcttcaagctttggaatggatgcaaatgttctaaaatataagagtcttcaagctgaagaaactaaccagcaaagctctaagcatacagccctccatctaactaaaaataaggatgagcaggccaataagaatgatggacaacccaccttatatctgaagttccaaagggagagttaatctagctttatactgctctgagaactgtgaatgaaggataacatatgcttatgtagtaaaaagaaaaaaaggaaagccctccccttcccctttccctatctctccccttacacatgcatatgcataaactaaaaattttagatatcccatcttctgtagtgggaacatctttcagagatttaaaaagaaatccagagaaaatatggaaaaatattaaagcagatatttatatttagtttttatcagcatggaaaaaaatctctgaagttttgatttcttccaaaactacttacacattcgacaccaaaaaaacttaagaactcaaagtaggaatgacatataatatgtcactgattttaacctccctactagacactttaatcaattagtcaacaaacatcatttcctgattttctgttatatcattagtgtgctaggaaccatttctctctactaggagattaccacataattgtacagataaaacatacctgaataaaatgattac

SEQ ID NO: 3683 - DNA, 7941 bp, Homo sapiens
tcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagactggagtacctgcaaggcgcatgatgaaaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgt

SEQ ID NO: 3684 - DNA, 1618 bp, Homo sapiens
gaataagcccgagcagccggtcctccagtggctccgctccccgttctctgtgggctcaaaatgacagaggctcacaggacacctgcatgcccaaggcactccaccgtatgtgatcaacctggatccagcagtacatgaagttccctttcctgccaatattggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatcttatacaaaaccaagctgcctttcattgtggtcatgaataaaactgacatcattgaccacagctttgcagtggaatggatgcaggattttgaggctttccaagatgccttgaatcaagagactacatacgtcagtaacctgactcgttcaatgagcctggtgttagatgagttttacagctcactcagggtggtgggtgtctctgctgttctgggtactggattagatgaactctttgtgcaagttaccagtgctgccgaagaatatgaaagggagtatcgtcctgaatatgaacgtctgaaaaaatcactggccaacgcagagagccaacagcagagagaacaactggaacgccttcgaaaagatatgggttctgtagccttggatgcagggactgccaaagacagcttatctcctgtgctgcacccttctgatttgatcctgactcgaggaaccttggatgaagaggatgaggaagcagacagcgatactgatgacattgaccacagagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactcttccaagcctacaacttcaagttttatcatttgaactcaagtacttttgctgctgaggaatggaatcaaaagaacgtagtctcctggtgaccacctcagatctctattattaggctagatgtatagcctctactcccccagcttcttgctcttgaccctgcactgtaagttgcccttctattagcagccaaggaaaagggaaacatgagcttatccagaacggtggcagagtctccttggcaatcaaccaacgttgctatgaaatatgcctcacactgtatagctcattataggacgtcaggtttgttgaaaaaagtgggcaagacatgattaatgaatcagaatcctgtttcattggtgacttggataaagactttttaatttt

SEQ ID NO: 3685 - DNA, 1677 bp, Homo sapiens
gtagtcataaaggtctctttgccaagttactgccctctcaagctgcttccagtgaatgctacacacctgcaccatggtttgtccgacatccttagccaagatcaggattggctatgttggtacttacatatcctcatgagaattgtggttctggtactagtttggtaaagaaattattaaacctagctgatgcttgaaggtagttggattaacaggaaagaaaagagacttcttttctagccaagatgaaagatacacaagacattcaggaagcttcgaaggcaatgcagaataaagtccatgagcaggaagataagaatgagaaacaaaaacaaagagaagacaaacttggagtatattctttagtacatttttccccaaagatgttgggttcagttgccacaacactgccattgtcatcttcaaattccagtggaatgcctcttggttactatctgtctagtcctcagattagtagagtaactatatcaacaactggacaattgacttctaaagctactgtaggtagctgttccagagtggaaaacagcttggatgccagccccttctcagttccgaagaaacaggatgaatcacccatgattggggatggagaagattatttcctttctttgtttggtgattcaaagaaacttacagcacactcaaactacactcagaaaactttaaaatacttttctatgattcttgaagaagttggccaatttacctccagttctcttggagatgttgaaatagctgaagtgaatgtcaagggtttgttcgtgaagctcattaactcttcccttgacaaagaaatggcaattggagatcatattctccagcaaaatgtgaatggacaaaccatttctttgtaccgattccttccaaacatcgtaatgcaggcaaattccacagtaacagtgtgggcagcagcatctgaagcaaagcatcaacctccatcagattttctttggaaggaacaagacaagtttagagcaagtcctgattgtataacaatcctgtgcaaaccgaacggtcaagccattgcgtggtacacccctatccactggaagcaagcgtgggaaaaattagatgctgacgttgaatttaacagatgttcagtagtatctccaacattccgaaagcgtgtgtttcagtggacagcatctacagctacaataactaaagaaaaacaagatcaacctaagaaagatatctcaaattatcaggtggaacaagctcaagttcttcttaagagagagaaggaaatcccaccaaccgttttccctaatcgcagcccttggtgccagaatccctatgtctctgcacatccttactgtcctctgattgaaccacacaatacatccaccgctggaggcagattggatagacagcccaggactcggtcaaccagacctaatcgagcctcagggtctaagaaaaagaagacatctgagtcacaaaagcaataagcagtcaactcaacctttaaagtaatctagtccaccctcaaccagctactagaaaagcaaaagagaactcaaatccctgaggcctgctctgcaacctccctgctattccatgagagggtgaagacatcacatttctatatggaaaaaggatccaaaatttgtattgctgtagaattggtgaattatagatgcttgatgaaat

SEQ ID NO: 3686 - DNA, 3097 bp, Homo sapiens
cagttcgatcaaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggaatcaattcatttacagctttccagtttttccagcctgcaagaggaggataaatctaggaaagatgactctgaaagagaaaaagaaaaggataaaaacaaagataaaacctctgaaaaacccaagatcagaatgttatcaaaagattgcagccaagaatacacggattctacaggcatagacttacacgagtttctgattaacacattaaagaataattccagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaataccagagcaaaggttttgtgaacatttaaaagatgaaaaaggtgaagaatcccagaagcggtttatcttgaagcgagataactctagtattgataaagaagacaatcagtcagtttgctcccaggaaagcctttttgtggaaaacagtaggctcttggaagacagtaacatatgcaatgagacctataagaaaagacagctctttcggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggccagccctttgtgaatcccgatggaactcctgcaatatacaacccacccaccagtcagcagcccctgcgaagcgccatggtggggcagtcccaacagcagccaccacagcagcagccctccccgcagccccaacagcaggtccagccaccgcagccacagatggcaggccctctggtcactcagtctgtccaggggctgcaggcttcctcccagtcagtgcaatatccagcagtctcttttcctccccagcacctcctacctgtgtctccaacgcagcactttcccatgagagatgatgtggcaacacagtttggccagatgaccctgagccggcagtcctcgggggagactcctgaacccccatcaggtcctgtctacccatcctcccttatgccacagccggcccagcagcccagctatgtaatcgcctctacaggccagcagcttcctacaggaggattctcaggctctggccctcccatctcccagcaggtcctccagccccctccctcaccacagggatttgtgcaacagcctccgcctgcacagatgcctgtatattattacccatctggtcagtaccctacctcaaccacgcaacagtaccggcccatggccccggttcagtacaacgctcagaggagtcaacagatgccacaggcagcacagcaagcaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacatt

SEQ ID NO: 3687 - DNA, 4829 bp, Homo sapiens
gtcacttccggtcgacggcggaaggcggaaggcggagcggtccctgcaacccggccggcgggaactgccttctagtttttagtctcagaccagaccaccgggcgcaccccgatgccgagcccgcagcttctggtgctcttcggcagccagacaggcacggctcaggatgtgtcggagagactgggtcgcgaggcccggcgccggcggcttggctgccgggtgcaggccctggactcctacccggtggtgaatctgattaacgagcccctggtgatatttgtttgtgcaactacaggccaaggagacccccctgacaacatgaagaacttctggaggtttatattccggaagaacctgccctccactgccctctgtcagatggactttgccgtcctgggcctcggggactcctcatacgccaagttcaacttcgtggccaagaagctgcaccgacggctactgcagcttgggggcagcgccctcctgcccgtgtgcctgggcgatgaccagcatgagctggggcccgacgctgctgtggacccctggctgcgagacttgtgggacagggttctggggctgtacccgccgcctccgggcctcactgagatccctcccggagtccccctgccctccaagttcaccctgctgttcctccaagaggcacccagcacgggctctgaggggcagcgggtagctcaccccggctctcaggagcccccgtcagagtcgaagcccttcctagcacccatgatctccaaccagagagtcaccggcccctcccacttccaggacgttcggctgattgagtttgacatcttgggctctggcatcagctttgctgctggtgatgtggtgctgattcagccctccaactcggctgcccatgtccagcggttctgccaggtgctgggcctggaccctgaccagctcttcatgctgcagccgcgggagccagatgtctcctcccccacgaggctgccccagccctgctccatgcggcacctcgtgtcccactacctggacatcgccagcgtgcctcgccgctccttcttcgaactcctggcctgtctatccctccatgagctggagcgggagaagctgctggagttcagttctgcccaaggccaggaggagctctttgaatactgcaaccggccccgcaggaccatcctggaggtgctctgtgacttcccgcacacagctgccgccatccctcccgactacctgttggacctcatccccgttatccggccgagggccttctccatcgcctcctcgctgctgatcctcgtggctgtagtgcagttccagactcgcctcaaggagccccgccggggcctctgctcctcctggctggcatccctggaccctgggcaaggacctgtccgggtgcccctctgggtgcggcctgggagtctggccttcccagagacaccagacacacctgtgatcatggtggggcctggcactggggtagcccccttccgagcagccatccaggagcgtgtggcccagggccagactggaaacttcttgttttttggctgccgctggcgggaccaagacttctactgggaggctgagtggcaggagctggagaagcgggactgtctgaccctcatccctgccttctcccgggaacaggagcagaaagtatatgtgcagcaccggctccgggagctggggtcgcttgtgtgggaactgctggaccgccagggtgcatacttctacctggcaggcaacgccaagtccatgccagcggacgtctcggaagccctgatgtccatcttccaggaggagggtggactctgcagcccggacgcagccgcgtatctagccaggctccagcagacacggcgcttccagacagagacgtgggcctgaggcccgcggctgcccgtgccccctctgacagccatcctcctgggagcccaggaaggcatccacgagggagctcctggccagcagccgtcatcctctcggaccagccagctggtcctctgggaacagccagctcccgagcacagccgcactcctgttgaccctggatcccaccctttgagcctgaccccactgcagcctctgcccagccagccctgcgctcccccaccctgacagtgagctgtgtcctcgtccccccacccccttcccagtcaaggtggtggcctgggccgctccacctcaccggtgcagtgacccaggacggcatcagcagcccagtgagcaccaggggtggcatagggcacccatgaggctgcgctgcactcctctgccctggggccacctcggctgctgcagcctgcccagcagcacattccagtcactgcccccgcactcccacagggctcaggctgggctcagaggccactgagatgccagctccttgagagcagtgggggtgtcccaggccagagcagcctcttcctctcctggtcccagaaaaacccttgcagtaaatggtggcctctgggtggttacttctagcgcaggcttccttccttcctctagctcctcccggtgccctgggtgctgggtgctggatggatgggcgtcctctagctcctcccggtgccctgggtgctgggtgctggatgggtgggcgtcctctagctcctcccggtgccctgggtgctgggtgctggatgggtgggcgccacggtgcacccttgttgggctgcctgtgcccgagtggcctctgcagctcttatgtctgcctctaatgggatgtgcgccctgactgcctcgttcttaagggcatagtgggtcggctaagatctgatcgccaggactgcgttctgggcaggtgctgggaaggcggaaccaagccgtccgtgccgctagggagccgagactgccggaaagaggagcggcaggagggggcgtggttgtgcagccccacccccgggaggggctttaggcactgggaaggaaagtcctgttggaggagttcggtggctgttcacacccgcctcgctgtcttggagtcttgatctgtcgtcggcgggtcgctggcacaggactaaacatggctgaggctgggctccagccagatctggctggggacagcaccgcgtgggcccaggatccacccagagcaggcaggccttgctggggccccagtcaagtccacttccagtgaggagagccagccgggaggtcagtgccagagctctggtggagcccagaccctgccttccctgagggccgcccctgtcgccgccctggggtccctgtcctcctatcctgactcctgccccagggccaccacccctgaactgtgccctggggcccccaccctccacctggccgactccagctctgggcctgtcagtccacctgggtcctctctgggccctgagtgcctggaccctctgtgccaagcaccagcaagcaaaggggatgaccttgggcacccccaaggtgctgagactacagccagtgagcccctgctgggggccaaagccatggagggtgcctgggcccttccaacctggaaggaggaggggagagagcaggcagcagggcagggggaagaggaggagtgcccgatctgcacagagccctacgggcccagagagcgccgcctggccctgctgaactgtagccacggcctgtgtgtgggctgcctgcacaggctgctgggctcggcctccagtgccgacctgggccgggtgcgctgcccgctgtgccgccagaagacgcccgtgctggaatgggagatctgccggctacaggaggagctgctacaggccgacgggccctcacgccagccccgccgagaggcccctgcatcctatcaccgcaaccctgggccctggggctccctggagcaccgctaccagctgcgcttcctggcagggcccgtgggcggccggggctgcctgcccttcctgccctgtccaccctgcctgggtgcccggctctggaccctgcgggagcggggaccctgtgcccgccgcctggcgctgctgagcctgctggcccttgagcttctggggctgctgctggtcttcacgccgctcctgctgctgggactgctcttcgtgctcctggaccgctctggccgctgagcagagcccaggacagccccgccgccaacaggccagggggcccagactggcccacgtccccatgcctgggtgctgtgaggcctgatgaccaggctggaaaaacccaaggttgggtccagggcaggggccttcaatcaagacctcccattgctgaacccacaaccagggctacccagaggcctgaccctgccagagtccatggctgcactgctgcccagacactagctgaacccaaggacaccagcgcccaaggacagctcctggaggaggccagcccagcaggaaagtctgtgagcaggaccccattcaccctgcggcagacgggcaccgtactggccacgggctgacgccggccacacttcccctccgagggccagctgagcacagcaggcatgaaagcaaacagagatacagcagtgagtcagttccttggagagggcagggactccgcccaccctgtgttcagataagggccagtgtgtgtccctgaaggtcaggccagccgggggaggggtccatgctgcgaaaattcagcctgcaaaggctcctctccccacttgatcaggcccagaccaggtgggggttggcgctggcctgtgttgcaggggacaagggcccacccaggccttggaacataagctctgcccctgcacaccctcatgtcaccacacctgggatggagacatcaggtggcccagcgagagatggaggactgatcctggaacgtgaagcagctttcaataaaccagctcctgggga

SEQ ID NO: 3688 - DNA, 3066 bp, Homo sapiens
gatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagag

SEQ ID NO: 3689 - DNA, 2571 bp, Homo sapiens
accgcaggcgggcctcgcgggtccgggagcgcggcggagacgatgcctgagatcagagtcacgcccttgggtgcctgccctgtgctgtcctggaacctggtccttccaccgggcagggggtcgagggcaccttccagcacagacaccaggacgggattccatgtcctcccccatggcgtgagcgcttcctcggagggtgccccccgccccggtgtggacactgtgctgtgaacacccctggcctgtgcacaccccatggcattttgcagctgtttgcatgggccccactgccctcccctgctctctgggtcctccgtggggtcctcccagcctgcccctttcccatttggcctcttggctgcctgttctgcccactctctggacatctgatctttctgatctttcatgtggcttcaattacccgcaatctgtacctgggtatattctcaaggtcacctcagccaaggcagcccctcggctgtggccccgtcatcctgatgtgtggtgctggctttggacacttcgagtggctggcagggggaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaac

SEQ ID NO: 3690 - DNA, 1251 bp, Homo sapiens
ggcaagagcggcagccacaccggcagattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtcagtattccttgccctccccaccccacgccccgcaccccccaccattgctgttttggcctctcttagctcatccatctgctgccctcagtccactcactaagggtgctgaggaaggaggcataagaagtcctttcttccaggcactgtccagtgatcctaatgattctcaattctctgagactcagtgactcctttttataacaaatattttgcttgaatttaattaatagataagtcataggtaaatccacatatgatttctacaaaacttaatatgctactctaataaatataaaagaaaaacaagaaaa

SEQ ID NO: 3691 - DNA, 4210 bp, Homo sapiens
ggtttcaaattggccctttggcctctggagcaaattcaaatgtaactcttccccaaccccccttctcttcttccagattaattaaaagaagaatgaactataatccttgaagataactgggcaattttttaagtcggaggctgttcttactggtgtgaggatttacacacgtcttcagtttttcagcacagaccagcagaccatcatttttagaggaaatactccctctgccctcctttttggtttccttggtggtaaagattaaatttggttgcatcattttgacttgtgtttgagtctagattttatggcacaaggaatggcataaacttttcatgtgttttggttaaaacaaaccagaccattgcattgaccctggacatctttaattgagaaattggtaactttattttaatatgtatatctgaagaattcaagaaaacaaaggcatcctcagaggtgtgcctcttttctttattattagaggcaaaacgaacaattttataggatttgtagtgaaattataccagattataaggagaaccaaaactaagtcgcaaaatttattaatttaaggggctctcgctttgaaagtttgagagtaagttacgataggcatttgtatccattcattactttcctcttttcaaataagcaactaaatagaaatgctaatctcagacttaattatttaacagaagagtgtaccatggaaaacctccagacaaatttctccttggttcagggctcaactaaaaaactgaatgggatgggagatgatggcagccccccagcgaaaaaaatgataacggacattcatgcaaatggaaaaacgataaacaaggtgccaacagttaagaaggaacacttggatgactatggagaagcaccagtggaaactgatggagagcatgttaagcgaacctgtacttctgttcctgaaactttgcatttaaatcccagtttgaaacacacattggcacaattccatttaagtagtcagagctcgctgggtggaccagcagcattttctgctcggcattcccaagaaagcatgtcgcctactgtatttctgcctcttccatcacctcaggttcttcctggcccattgctcatcccttcagatagctccacagaactcactcagactgtgttggaaggggaatctatttcttgttttcaagttggaggagaaaagagactctgtttgccccaagtcttaaattctgttctccgagaatttacactccagcaaataaatacagtgtgtgatgaactgtacatatattgttcaaggtgtacttcagaccagcttcatatcttaaaggtactgggcatacttccattcaatgccccatcctgtgggctgattacattaactgatgcacaaagattatgtaatgctttattgcggccacgaacttttcctcaaaatggtagcgtacttcctgctaaaagctcattggcccagttaaaggaaactggcagtgcctttgaagtggagcatgaatgcctaggcaaatgtcagggtttatttgcaccccagttttatgttcagcctgatgctccgtgtattcaatgtctggagtgttgtggaatgtttgcaccccagacgtttgtgatgcattctcacagatcacctgacaaaagaacttgccactggggctttgaatcagctaaatggcattgctatcttcatgtgaaccaaaaatacttaggaacacctgaagaaaagaaactgaagataattttagaagaaatgaaggagaagtttagcatgagaagtggaaagagaaatcaatccaagacagatgcaccatcaggaatggaattacagtcatggtatcctgttataaagcaggaaggtgaccatgtttctcagacacattcatttttacaccccagctactacttatacatgtgtgataaagtggttgccccaaatgtgtcacttacttctgctgtatcccagtctaaagagctcacaaagacagaggcaagtaagtccatatcaagacagtcagagaaggctcacagtagtggtaaacttcaaaaaacagtgtcttatccagatgtctcacttgaggaacaggagaaaatggatttaaaaacaagtagagaattatgtagccgtttagatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatagaaactgttaaagagattcatctgtgtattactgacaaggttttttttgtttgttgcttgctttggtaattgaattctgaagaatttatctgcatgacgataactaggcattctatccatttgtagatcagagaaagtgaagagattatatattagtacttaaatttttacattttccaaatgaatgaaaatgtatgtttctttgtacttttttaaaaaaatcagcttagtaacaatactatatggtttcaactagtaggtaatctgcttatatttctaatgcaaacttaacaattgtgtactttttaaaagctgcaatatgtgttggaaaatagctgtggtcaattttgttatccatatttcagactcaattttagatacaatggtggctttatattttaagtatatagagctactcaaggagttgaatctccccttttctcattaacacaatttttctaagttgatatggtgtactcattaacatacaccaaatttacttttactttgttcagattgtggaatgaatttccaccagttctcttctttttaatgtgtaccctaggaggaattttactgaggttatagcataccccatgagcacagtggggaagaagaatgtgttgttatgtgctgctgctaaacagaagcagcagttgtaatttgtttttcagtttaaatgtggttatagttagatttttttttaagcagcaacttttcaaaaataaaatgtgataatttctgaacttttgtttgtgttgttaatagtggtgtgaaaatattaacgttcttgagaaaaactgataccactgttgtgtatcagtttctatacaatccataatcctcctgtacagtttttacatgtagttatgagtcttactaaaatttatataatggacttgttttcctttaagttgtaaaatgttaaacaccttgaaggttattttggacttctgtatgtttaaatgttgtcttaccaaaatttgcacgaatggaccattttcatttactacttaatatcaaaatcaggaatttacagtcaactgatagtacatgataggtgcatataggacagtttagttacctgctactaaaagatttttagataagttttagaagataaaggaattccatagtttcaggagggacaacatcttctgcactttttttttgcacagaaaagtctgtcattctctaatggcaaatttcatatttgttaattcttggctcaaaatatattaggtaaaattcttagatctgtttttaaagggagtttcctgaaactatcattaattgacattattaccccatggattttatgggataataaatgtttttcatgttctcttataagatactatgtatgaaattacttcagagagctatatttattttaaaataaattagctagggttaaggttatattctatttccagcatagaaggta

SEQ ID NO: 3692 - DNA, 5971 bp, Homo sapiens
agagcctcggtggtttgcagcagtggaaccaggcaggcccagttgtgggtaggagaggccgtcacctgttgaggcctcccccccacacccccgcatcgccctgccctggcagagcccagcccccagtccccggagagcgcgcctgaggacggacggacggacggacggacagacctagggacggagggccaggggcaggggagatccaagaggccccgcgctggaatgcagttttctcgggcgagggagactttgcaccggagtggaaaatagtttggggtggggtttcgcaccgtcccctcctccccagccccgggccccctcccaggcgctttctgggagcttttagaactgcgctctgaagtttccagagagcgaggagcttttgcggcaggcagagacaatggaagaaaatgaaagccagaaatgtgagccgtgccttccttactcagcagacagaagacagatgcaggaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccaggcattccagaagtgttcctttatggatgtaaattcaaacagtcatgctgagccatcccgggctgacagtcacgttaaagacactaggtcgggcgccacagtgccacccaaggagaagaagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatc

SEQ ID NO: 3693 - DNA, 1070 bp, Homo sapiens
aaataattcacaagttggccatgcagctgagacacattggggacaacattgatcataggatggttcgagaggatcttcaacaggatggcagagatgcactagatcattttgtcttctttttctttagaagagttcaggtgttgctgcattttttctggaacaaccatttgctgtaaaaggaaagtaaagagaacctcgtcctcaaactaaaggccacagaaatgggcactacctcctggcccactccctgggcaccatgccctctggtgacctgttggctccactcttgtcactcatgtccagatctgcagtgccagcttctccttctcggtgacatgtcacctccctgccccaatcctggctccaaccctctctggaaaatcgaagtgaaacatttgtctctaatactcaaattcaacatatggctcatctcatctaccttcccatttccatgcctagaggccccactactaccactagcaccgttgggtgtttccttctcaggctctgattctacaacatttacgttcttttctcacctttgatcccctcactcctctgtgacccccttcaagtcttccttcaccactccagtgttttcccataccactcgaccctgctcgaaggtatctttccctgctctgtcatcctcttttaggcatgcctgcttaaaatcgggagtgcttagtccttggccaacagtcctgccttctagaagaatgtaagacctgaaagagttatgaatctatcactaggcaaaaacttctcttttcctattgctggatggttttgctattattggttggtgggccctttgcctgtggaatgtatttcactcattctctcctgcacgctgttaggcagttctttcacctgcatgcttcttcttttacctttttgtctacctcatagtccctctctcccctcctttaaaagaattataaatattaggaaagcttgttgttataaattaaaagtttacatatgtatcttgagttcttcataggggaagtgttattttaaaaaattctaaaaatgaaataaatattgttattttattgagcatgaaa

SEQ ID NO: 3694 - DNA, 544 bp, Homo sapiens
agaactgtgggattgatgacctcccacaactggagcagccgggaacagctctgaccacacagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaataggtgtgtatg

SEQ ID NO: 3695 - DNA, 579 bp, Homo sapiens
agactcggttggtgactccgggcgcgtcgaagatcttgtacctgtcgttcgcagtggctcactttcccagtaatccataagaacagcagggataacagggtcccatgtcgtttttttgtcagaattcctcgactggcgaccctgtgcccgacaggctgcaccgcgcccggcgcactgactccggcctctgcgcgcgccccctggccggctccggggtggggagggggcttcgcagatccccagaaaaccgcccggcgagccacgagcccgtggactgcaggctccgcttcctcgcggggtgttcactttgtatcagtgtgctgatttgccgccagttagaagcaccttaaaaaggggccgggggccgtaggaggggggcttgtctgaaggaggctctgggcttgctgatccacgcagcggtttgtcgcgaggctgcgggggaacggcccacggccgcggtaacagggcttcgtcttctttgcagagccatgggcagcaggaagaaggaaattgccctgcaggtcaacatcagcacccaagagctttgggaggaaatgctcagttccaaaggactaactg

SEQ ID NO: 3696 - DNA, 1293 bp, Homo sapiens
acgcgcatggaacgcagcgaaggactatggcaggggagaacttcgctacgccgttccacgggcacgtgggccgcggcgccttcagcgacgtgtacgagcccgcggaggacacgtttctgcttttgaacgcgctggaggcagcggctgccgaactggcaggagtggaaatatgcctggaagtagggtcagggtctggtgtagtatctgcattcctagcctctatgataggccctcaggctttgtacatgtgcactgatatcaaccctgaggcagcagcttgtaccctagagacagcacgctgtaacaaagttcacattcaaccagttattacagatttggtcaaaggcttgctaccaagattgaccgaaaaagttgatcttctggtgtttaatcccccctatgtagtgactccacctcaagaggtaggaagtcacggaatagaggcagcttgggctggtggcaaaaatggtcgggaagtcatggacaggttttttcccctggttccagatctcctttcaccaaaaggattattctatttagttaccattaaagaaaacaacccagaagaaattttgaaaataatgaagacaaaaggtctgcaaggaaccactgcactttccagacaagcaggccaagaaactctttcagtcctcaagttcaccaagtcttagcatacagtgtgtgcccagaactactggaaactgaatgcatttagcatattttgaaactgaagtcattcattagatggatttacatcactggcttccctggttctcaagcctttggattcagactgaattataccacaggccttcctgggtctccagcttatagatgacagatcatgggacctcttagcctccataatcatgtaagccactttcttgtagtactggtaaaagatatattaaaccaatctataaaacagatagctatgaaagagaaaggtgacaggcacaagcctaggcaaatagagaagggttcctggacagcctctgacttgcctaggtcattgtgcacacgtggcttgcctgaatgaacatgcccactgtgaaagattccatttctcaacacatgtgcagtaagggaaataaatcaatgtggctcaaactaaccgcccacacatggggtggagccacaaggagtttgctccttatgcaggggagaagccgtgcctcttcagctcgtgtgtggtggcctggcattcaatttgtgaggtgtaaaacctgcatgaaggacccctctttttgtggagagctttccttttgcctaataaattctgccctcctcgcc

SEQ ID NO: 3697 - DNA, 2958 bp, Homo sapiens
gctccaagttgccgccagaacccatggccggcgtggaaaccgctgcgaggcggcgccacgacggaggctgaggtcgccggcagtatccatggcgtcccagagcggcagctccctggggctcctggcctggttcttgcttcttcagccatggctcgaagaggcccgggcaggcagggtgggtgcgcagggaggcgtagcactgctcttcccctccgcgctcccctcagggccaggcggccaggaccccggagcgagcggatgggagccgccacctgtaggggctccaggatccccagcggccccccagtccagggggaacgcagtgcgccccgcttcggtgttacttccctcaggtgagccataccgacccgaggaggattccagaatgaccccggcaagcccagaagcccggacgtctcctgtgcacccgaaattccccaaaattccagaaacttctgtagctccagggtctccagcgaccgcagggcctccaggatcctgggttacttcagcatctacagtgggagaagccttggaatccgacggaatctctgaccttggaaggcagttttctcagggtattgtttctggtgctagatctgtcctggcctgcggggtaggtcaaaggggacacagcctggctcagggaggttgagggtcagaccctgacctagatgatttgagagagaggatagataacccgcctccgccctgggcagcctggtggggtggtgggaaggtagtggcttcacttccagtcccctctctttactgagcccaccagcctgtggccaccgtgtttcaaggatgattggaggattgccagccccaaacaagaagtggccctggcaggtgagcctgcagaccagcaacatacaccactgcggaggctccctcatcgacaggcgctgggtgctcactgccgcccactgtgtctttagtttcaggaccaatgccacttgttcttcaggagactgagctaaacattatgcgtcatgagaaatgttgtgagatgctcaagaacaagaatatatccaagagtaaaatggtcacgagggggaccgtctgtggctataatgaccaagggaaggatgcctgtcaggttataaagaggacacaaccaatccaggttgactctggaagctcccttgtctgccaaatggacaagacctggattcagataggagtgttccttgggcaaagccccactggaggggctggagggaaagtagggtcacttggagatcctggatgccagcccctgaggtttggtcttcatctcactgcgggaggggtgacaccatgagccagtccagggcaatgggctgcgagggtgaggaggtctgagaatcggccgagattaagttgagggactccaggagactgcttggaccagcggagtgaggagagggaggggccaaggagggaagtcagccggggcgtacccagcccgggaggtataagggagggctgtcactaggggcgcccttgcgggtcagacaccacgagcgccgtggcgggtggcccctggggggcgccacgcaggcggggcactaggagcatccccacccagctcaccagaggccgcggcatgcggccaacagggggcgccgtcgtgggggcggcactgggagcgccttccggagagacgcagtcggctgccaccccgggatgggtcgctggtgccagaccgtcgcgcgcgggcagcgcccccggacgtctgccccctcccgcgccggtgccctgctgctgctgcttctgttgctgaggtctgcaggttgctggggcgcaggggaagccccgggggcgctgtccactgctgatcccgccgaccagagcgtccagtgtgtccccaaggccacctgtccttccagccggcctcgccttctctggcagaccccgaccacccagacactgccctcgaccaccatggagacccaattcccagtttctgaaggcaaagtcgacccataccgctcctgtggcttttcctacgagcaggaccccaccctcagggacccagaagccgtggctcggcggtggccctggatggtcagcgtgcgggccaatggcacacacatctgtgccggcaccatcattgcctcccagtgggtgctgactgtggcccactgcctgatctggcgtgatgttatctactcagtgagggtggggagtccgtggattgaccagatgacgcagaccgcctccgatgtcccggtgctccaggtcatcatgcatagcaggtaccgggcccagcggttctggtcctgggtgggccaggccaacgacatcggcctcctcaagctcaagcaggaactcaagtacagcaattacgtgcggcccatctgcctgcctggcacggactatgtgttgaaggaccattcccgctgcactgtgacgggctggggactttccaaggctgacggcatgtggcctcagttccggaccattcaggagaaggaagtcatcatcctgaacaacaaagagtgtgacaatttctaccacaacttcaccaaaatccccactctggttcagatcatcaagtcccagatgatgtgtgcggaggacacccacagggagaagttctgctatgagctaactggagagcccttggtctgctccatggagggcacgtggtacctggtgggattggtgagctggggtgcaggctgccagaagagcgaggccccacccatctacctacaggtctcctcctaccaacactggatctgggactgcctcaacgggcaggccctggccctgccagccccatccaggaccctgctcctggcactcccactgcccctcagcctccttgctgccctctgactctgtgtgccctccctcacttgtgggccccccttgcctccgtgcccaggttgctgtgggtgcagctgtcacagccctgagagtcagggtggagatgaggtgctcaattaaacattactgttttccatg

SEQ ID NO: 3698 - DNA, 550 bp, Homo sapiens
actgactcagtgacctcggggtcgttaggcctccacgtcctcgctggagctgcggacctcagtcgtccatccacacctcccccctgccgcccccgcccatctcactctcccaaccctgggcaccagggcaggtcgacagcccgaggcactcctctactgcgtttccaggcccaggagacccactccagcgccgcggttccttgcgacccggcagccgttcagcagacctcccattctttcctgcatcatcgggcattgtggaggcaccctacgaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgag

SEQ ID NO: 3699 - DNA, 666 bp, Homo sapiens
ggcggagcgagtggaggctgcagcccagctcgtctcggcgcccgcgtcgccgtcgcgaagccccccgccccgcttccgccgcgtcggaatgagctcccggaaagtgctggccattcaggcccgaaagcggaggccgaaaagagagaaacatccgaaaaaaaatcaagcagaagattgagctgctgatgtcagttaactctgagaagtcgtcctcttcagaaaggccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatac

SEQ ID NO: 3700 - DNA, 604 bp, Homo sapiens
actttgtttatgggacagtccgggagctgctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaagttcgggcgggacggcggccgccgcgcgctcaggctcagcttcgctgcccgcccaggtagtgcccgctggagctcgcgcgctcatccggcaccactccagggctccaggctcctcgggcttccggagtcgagacgtggtggagttggctcgggctgaacttctttcggggggctgcctgtcctggaatcgtgcgacctttcctttgccatcctgcggttcagcaagccccgagtgcagttattccctccacccctcgccctatcttctcctcctccaggcaacttctttgcttcaagaaagttgcataattctcgagaagatgaatccggcctcggcgccccctccgctcccgccgcctgggcagcaagtgatccacgtcacg

SEQ ID NO: 3701 - DNA, 2147 bp, Homo sapiens
attgttcgcagctgatgtcactcgcagttgtgagcggccgcctctcccggggacaatgtgggactgagcggcccagccgccgtgccgccgccgccgccgccgcaggacagccccagcgaggccatttccagcacatagaagagagattggaaaccaacgtgcagaactgccagtcccctgacacgctgtgccccacccactgcagcccagtgctgaatgaaccctgcccagaggtgtctgtagtgagcttctgccctagtgacttttgagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgacca

SEQ ID NO: 3702 - DNA, 6981 bp, Homo sapiens
gggcggcctatagatccaagagaaggtcctggacggcctccactagatggtagggatcattttggaagacctcctgtagatataagagagaatcttgtgaggccaggtatagatcatcttggtcgaagagaccactttggctttaatccagagaagccctgggggcatagaggagattttgatgagagagagcatcgggttctaccggtctatggtggtccaaaaggcttacatgaagaaagaggtagatttcggtctggaaactatcgatttgatcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacataatcatcactcagtaggttaatgatgaaatggcaggtaattcacacttttggacagagcgcaccgcccccgtggaatcaccctacagaagaggccagctataaaggatgtctcacacctttaagatcagtgtttctcaatgtgtggaccatggatacctgtattagaatacccaaaggatttgtttaaaattcaggctgagcccttcccaagacctaatagagctaaaagctttgggagtaggtggaggaaacctgcatctttacccagcaatccaggacagaatgacttggaagataacggagcttcgaagcttctagcagaatatgaagtctttcgtcttcagctacctgggttaagtttaagcagggctctgtgtatgaatgacaaggataccttcagccagctcattctggatgaatgaatgattacactaagtgtcctccacattcctctgtgggctcacttcatggactcactttgcgtgcttgttaaatgtgctgtgttgctcccaagaccatgtaaagcctactgaccactaacctccctcacagcagaaactagacgtcaggttaaaatgggcaactccgacagtcagtacacccttcaaggatctaaaaatcatagcaatactattactggtgctaagcaaattccttgctccctgaaaatacgtggcattcatgcaaaagaggaaaagtcattgcatggatggggtcacggaagcaacggagcaggttacaagtccaggtccctggcccgaagctgcctttctcactttaagagtaaccagccttacgcatcgagactcggtggccccacatgcaaggtctccagaggtgttgcctactccacgcacaggacaaatgccccagggaaggatttccagggcatcagtgctgctttctcaactgagaatggcttccactctgttggccacgagctggcagataaccacatcacctccagagactgcaacggacaccttctcaactgctacgggaggaatgagagcattgcctccaccccaccgggcgaagaccgcaagagcccccgagtgctcatcaaaacgctggggaagctggatgggtgtttaagggtcgagttccacaatggtggcaaccccagcaaagtgcctgcagaggactgcagtgagccggtgcagctgctgaggtactcacctaccttagcatcggaaacctcccctgtgcctgaagccaggagggggtccagcgccgattccctgcccagccatcgcccctctcccacggactctcgcctgcggtccagcaaaggcagctccctgagttctgagtcatcctggtacgactccccttggggcaatgctggagagctgagcgaggctgagggctccttcctggcccccggcatgcctgaccccagtctccatgccagcttcccacctggcgatgccaaaaagcctttcaaccaaagctcttccctctcctccctccgggaactgtacaaagatgccaacctggggagcctctccccctcaggtatccgcctttctgatgaatacatgggcacgcatgccagcctgagcaaccgtgtctcttttgcttccgacattgatgtgccctccagagtggcacacggggaccccatccagtacagttccttcactctcccctgtcggaagcccaaagcctttgttgaggatactgcgaagaaggactccctcaaagccaggatgcgacggatcagtgactggacgggaagcctctcaaggaagaaaaggaaactccaggagccgaggtccaaggagggcagtgactactttgacagtcgctctgatggactgaatacagatgtgcagggatcctcccaggcatctgcttttctgtggtcagggggctctactcagatcctgtctcagagaagtgaatccacacatgcgattggcagcgatcccctccggcagaacatttatgagaatttcatgcgagagttggaaatgagcaggaccaacactgagaacatagaaacatctacagaaaccgccgagtccagcagcgagtcactcagctctctggaacagctggatctgctctttgagaaggaacagggggtggtccggaaggccgggtggctcttcttcaagcccctggtcactgtgcagaaggaaaggaagcttgagctggtggcacgaaggaaatggaaacagtactgggtaacgctgaaaggatgcacgctgctgttttatgagacctatgggaagaattccatggatcagagcagtgcccctcggtgtgctctgtttgcagaagacagcatagtgcagtctgttccagagcatcccaagaaagaaaatgtgttctgcctcagcaactcctttggagatgtctaccttttccaggccaccagccagacagatctagaaaactgggtcactgctgtacactctgcttgtgcatccctttttgcaaagaagcatgggaaagaggacacgctgcggctgctgaagaaccagaccaaaaacctgcttcagaagatagacatggacagcaagatgaagaagatggcagagctgcagctgtccgtggtgagcgacccaaagaacaggaaagccatagagaaccagatccagcaatgggagcagaatcttgagaaatttcacatggatctgttcaggatgcgctgctatctggccagcctacaaggtggggagttaccgaacccaaagagtctccttgcagccgccagccgcccctccaagctggccctcggcaggctgggcatcttgtctgtttcctctttccatgctctggtatgttctagagatgactctgctctccggaaaaggacactgtcactgacccagcgagggagaaacaagaagggaatattttcttcgttaaaagggctggacacactggccagaaaaggcaaggagaagagaccttctataactcaggtcgatgaacttctgcatatatatggttcaacagtagacggtgttccccgagacaatgcatgggaaatccagacttatgtccactttcaggacaatcacggagttactgtagggatcaagccagagcacagagtagaagatattttgactttggcatgcaagatgaggcagttggaacccagccattatggcctacagcttcgaaaattagtagatgacaatgttgagtattgcatccctgcaccatatgaatatatgcaacaacaggtttatgatgaaatagaagtctttccactaaatgtttatgacgtgcagctcacgaagactgggagtgtgtgtgactttgggtttgcagttacagcgcaggtggatgagcgtcagcatctcagccggatatttataagcgacgttcttcccgatggcctggcgtatggggaagggctgagaaagggcaatgagatcatgaccttaaatggggaagctgtgtctgatcttgaccttaagcagatggaggccctgttttctgagaagagcgtcggactcactctgattgcccggcctccggacacaaaagcaaccctgtgtacatcctggtcagacagtgacctgttctccagggaccagaagagtctgctgccccctcctaaccagtcccaactgctggaggaattcctggataactttaaaaagaatacagccaatgatttcagcaacgtccctgatatcacaacaggtctgaaaaggagtcagacagatggcactctggatcaggtttcccacagggagaaaatggagcagacattcaggagtgctgagcagatcactgcactgtgcaggagttttaacgacagtcaggccaacggcatggaaggaccgcgggagaatcaggatcctcctccgaggtctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacggaagcactaaaggcaatggagaaagtagcgagccacatcaatgagatgcagaagatctatgaggattatgggaccgtgtttgaccagctagtagctgagcagagcggaacagagaaggaggtaacagaactttcgatgggagagcttctgatgcactctacggtttcctggttgaatccatttctgtctctaggaaaagctagaaaggaccttgagctcacagtatttgtttttaagagagccgtcatactggtttataaagaaaactgcaaactgaaaaagaaattgccctcgaattcccggcctgcacacaactctactgacttggacccatttaaattccgctggttgatccccatctccgcgcttcaagtcagactggggaatccagcagggacagaaaataattccatatgggaactgatccatacgaagtcagaaatagaaggacggccagaaaccatctttcagttgtgttgcagtgacagtgaaagcaaaaccaacattgttaaggtgattcgttctattctgagggagaacttcaggcgtcacataaagtgtgaattaccactggagaaaacgtgtaaggatcgcctggtacctcttaagaaccgagttcctgtttcggccaaattagcttcatccaggtctttaaaagtcctgaagaattcctccagcaacgagtggaccggtgagactggcaagggaaccttgctggactctgacgagggcagcttgagcagcggcacccagagcagcggctgccccacggctgagggcaggcaggactccaagagcacttctcccgggaaatacccacaccccggcttggcagattttgccgacaatctcatcaaagagagtgacatcctgagcgatgaagatgatgaccaccgtcagactgtgaagcagggcagccctactaaagacatcgaaattcagttccagagactgaggatttccgaggacccagacgttcaccccgaggctgagcagcagcctggcccggagtcgggtgagggtcagaaaggaggagagcagcccaaactggtccgggggcacttctgccccattaaacgaaaagccaacagcaccaagagggacagaggaactttgctcaaggcgcagatccgtcaccagtcccttgacagtcagtctgaaaatgccaccatcgacctaaattctgttctagagcgagaattcagtgtccagagtttaacatctgttgtcagtgaggagtgtttttatgaaacagagagccacggaaaatcatagtatgattcaatccagatatgggttaaattcctcattttacttttaaactggtggtaaagtggaaattgcaaaaaaaaaaaaaaaaaaaaactgttcattcctgggttttgtgcagtatacattttcccacaaaatggttgtaaagatttaagttattttaatttattgtggatcagaaacctagatgaaactggtcagaatctgtaaattacttagtttatatccactttgagcaggtatcaaatgatttaggatccttaaaattacattctaataattaagttatgtggaaaaagtaaggctggggaagtcgtgattaatagttttcaaagggccattttttaaaatcctctgggcattttctttcagctgtttgttagtttttgctttatttaaagcatatttaagttattttaatgtggtttaggggcaaaatgtgcagatacttcatttttgtaagatagattgtaatagatgctgtttatactaaacatgtcataactatctatacagtatatattaaaagaaagcttgtactgtatcttatttgatgatatttattttctctgccaagctgtatagtaaaaggaaaataagtcaca

SEQ ID NO: 3703 - DNA, 727 bp, Homo sapiens
cgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctccca

SEQ ID NO: 3704 - DNA, 5033 bp, Homo sapiens
cggagccgaaacaccggtaggagcggggaggtgggtactacacaaccgtctccagccttggtctgagtggactgtcctgcaggtaaagtacttctcttcctggtcaggttgtcacgctcttacttcctgccttgtccgcgagcgcctggaaaatagaggccttgagcccgagcggcgaagtccgggcttgaagctgccgctgggagatttctcttgctgtcacccctcccccctcggccgctccccggcggcccgggctcccgcgcgcagctcccgggcgccacttttccaagctactcaaatgtctcggggaggccctgagcctcgcagatcttttctttaaaaaatcctagtctctatctggaaaagggcgtctccccctacccctcttccttctgccaacggactagtcaccgggtctcagccttcgctggtgacctttcatggtttactgtccaacgggactccgcctggggagctggagagacaaactcttgccactccaaaattagcaagcgctgccagcgtccgacttgaagttgctagtggttagtcccagccttcgcccttcgcggtccgaccgctgagaggagggagacttcgttatgccccgggccgtcaacggcgccaggagctaaagggcgggcagacgaaagcgggcggcgagtcgccagttagtcttcaccgctctggagagagttgctagccacgggatcctgacccggacacgaactcgtttctccacgtcggtgcgcgcttgcatccctggccccgaaagcgtgggaatgtccggaaatgctggcgtatgggagttccttaattagaaatgcgttagcgaatattatacgcttatactatgggcggacgggtggagagccttaaaaacaacaacaacaaactaagcagttgctcaatcgttgattgatcctcaggcacgtctagattttcccacttacataggtcttgttaagaaaccagtcctgccttcttgccactcgtgtctttcgatggctcccttcccgaagtcccgctgcctctaagcggagtgttaagcggggctctcggaagccggtggaccgagatttccccgggtggggcgggcgcggtgtagcggcccgcgggctgacttgctcccggctgtcccccggccccagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagatta

SEQ ID NO: 3705 - DNA, 493 bp, Homo sapiens
acaactggagcagccgggaacagctctgaccacagtggttccggggagaagcctttccaggacccatgtgtaggcacaactgttttccctgatcaggatacttgcggcactcaagaattctccgaagtttgaaggttatgaatggttatcactcaaggattcagaactaagcagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttg

SEQ ID NO: 3706 - DNA, 4246 bp, Homo sapiens
gatgagattgatgattctttctcctggaaaacctttcatcacagagattcatctcagcattaaagggcagtatttaaagtcagttggcaagcagtggaataagatttttgtaaagaaaccttgtgcagcatggattctctaccagatgaattttttgtgaggcatcctgctgtggaggatcagaggaaggaagaaactgagaataagctagaaaaatcatctggtcaactgaacaaacaggaaaatgacatacctactgatcttgtccctgttaacctactattagaagtgaagaagttattaaatgcaattaatactctaccaaaaggtgtggttcctcacattaagaagttcttacaagaagatttttccttccaaactatgcagagagaagttgcagctaacagccagaatggtgaggaaattgttcctgctttgactttacgtttcttgattacacagctagaagcagcacttaggaacattcaagctggcaattataccgcacaccagattaatattggttattatttgacattactgtttttatatggagtagcactcactgaaagaggaaagaaagaggattatacagaagctgagaataaatttctggtgatgaagatgatgatccaagaaaatgaaatttgtgaaaactttatgtctttagtttattttggacgtggtttactgcgatgtgctcaaaagagatataatggaggactgctagaatttcataaaagcttacaagaaattggagacaaaaatgaccattggtttgacatagatcctacagaagatgaagatttacctacaacttttaaagatcttcttaataattttatcaagacaactgaaagcaatataatgaagcagacgatttgtagttacctagattgtgaacgatcttgtgaagctgacattttgaagaacaccagttataagggattttttcagttaatgtgcagtaaaagttgctgtgtttatttccataaaatttgctggaaaaagttcaagaatttaaagtatccaggtgaaaatgatcagagttttagtgggaaaaaatgtttgaaggaaggatgtacaggtgacatggtaaggatgctgcaatgtgatgtacctggaattgttaaaattttgtttgaagttgtgagaaaggatgaatatatcaccattgaaaatttaggagcaagttatagaaagttgatatctctgaaaataactgatactgatataagaccgaagatcagtttaaaatttaatacaaaagatgaaatgcctatcttcaagcttgattataattatttctatcatctgcttcatataattattatttctggtactgacattgttcgacaaatatttgatgaggctatgccacctcctcttttgaaaaaagagcttcttatacacaagaatgtgctggaatcctactacaaccatctttggaccaatcatcctttgggtggatcatggcatctgctttatcctcctaacaaggagttaccgcaatccaaacagtttgacttatgcctcctgttagctcttataaaacatttaaatgtgttccctgcacccaaaaaaggatggaatatggaaccgccatcttctgacatctctaaatctgcagacatcctgagactgtgcaaatacagggatatcctccttagtgagattttgatgaatggtctcactgagtcacagttcaattcaatttggaaaaaagtttcagatattcttctgcgccttgggatgatgcaagaggatattgacaaagtgaaggagaatcccattgagaatatctcccttgattaccatcagctatctgtctacctaggcataccagtaccagaaatcatacagaggatgttatcctgctatcaacaaggaattgctctacagtcaataacaggcagtcagcgtattgaaatagaagagttacagaatgaggaagaagaactaagtccacctctcatggagtacaatataaatgtgaaatcacaccctgagatacagtttgcagaaattaataaagatgggacctcaatacccagtgaatcttcaacagaatctcttaaagatctccaggaagttaagagtaaacaaaggaaaaagaagaagactaagaataaaaagaataaagactcaaaagaagaccaagtcccatatgtggtagaaaaggaagagcagttgaggaaagaacaagcaaatccacactcagtcagtagacttataaaagatgatgcaagtgatgttcaagaggattctgcaatggaagacaagttctatagcctggatgaattgcatattctggacatgatagagcagggctcagctggcaaagtaactacagactatggagaaactgaaaaggaaaggcttgctcgtcaaaggcagctttataaattgcactatcagtgtgaagatttcaaaagacagttgagaacagtgacttttcggtggcaagaaaaccaaatgcagattaaaaagaaagacaaaattatcgcatctcttaatcaacaagttgcttttggaatcaataaggtttccaaattacagcgtcaaatccatgctaaagataatgaaatcaagaaccttaaagagcaactttctatgaaaagatctcagtgggaaatggaaaaacataatctggaaagcacaatgaaaacatacgtaagcaaactgaacgcagaaactagcagagctttaacagccgaggtgtatttcttacagtgtcgtagggattttggtttgcttcatctagagcagactgaaaaggaatgtctcaatcagcttgccagggtgactcacatggcagcaagcaacctagaatcacttcaattaaaggctgcggtagacagttggaatgccattgtggcagatgttagaaacaagattgcattcctcaggacacagtacaatgaacaaataaacaaagtcaagcaaggatttgccttgagtaccttgcctccagtccagcttcctcctccaccacccagtcctgagatactgatgcagcagttcttaggaagacctcttgtgaaagaatctttctttagacccatacttactgttcctcaaatgcctgcagtttgcccgggagtcgtctctgcaactggccaacctagagcccccctgatgactggcatagcctgggctctgccagcgcctgtgggagacgctgtgcctcccagtgcaggtctgcggagtgatccctccatcatgaattgggagagaattacagacaggctgaaaactgcctttccacagcaaaccagaaaggaacttacagatttcttacggaaattgaaggatgcttatggaaaatccttgtctgaactgacatttgatgaaattgtttgcaagatttcccagtttattgaccccaaaaagtctcagagtcaaggaaaatcagtgtcaaatgttaattgtgtttcacctagtcattctccatcacagcctgatgctgcccagcccccaaaaccagcctggaggccactcacttcacagggtcctgccacatgggaaggagccagtaatccagatgaggaagaggaagaagaagagccttgtgtgatctgtcatgagaatctgtctccagaaaatctttcagttttgccttgcgctcacaaattccatgctcagtgcattagaccatggttgatgcaacaggggacatgtccaacgtgcagactccacgttttgctaccagaagaattccctggtcaccccagccggcagttgcccaagatctgatacaaggtcggggtgtctatgcaaaggaagctcagttttcttttattatgagctgcttgtttgagtggtgtaaaactatgtgctcttcaatatagtgctaaagaagccagctaattttatcaaagcagcagccaaagaagtcaggacaaatcttcaggacttgtgaaatgaactgaaagagcttgaagcagatggaattttaatagttacactatatatgctcttagtaggtttttttcttgtagtggaaacataactgttagcatatttcttaggatgttttttcttgtctttttaaattcttatttcactcatcctttactctcccctcaagtattctacactttaatttcctgaaataaatttaaggaaaagggaaatagtaaagaagtaggaatgggtgcagcacaccagcatggcacatgaatacacatgtaactaacctgcacattgtgcacatgtaccctaaaacttaaagtataataataat

SEQ ID NO: 3707 - DNA, 2730 bp, Homo sapiens
cttttaggagagcactgctgcagccggcagtggagagcctgggcagggagacagggagaaaactccggcagcagggtggtctctagggctgacctcggagcctggggacaggggagcctatgccgcactgaaggcgggacgctactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtg

SEQ ID NO: 3708 - DNA, 1915 bp, Homo sapiens
atcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaatatttctgaggacaatcccagacccaggagatgttccagactcatttttctgatattcagagagggcaagagtcttggcctatgtcacacagcagagtccaggactccagaactccaacctagcactctggccagaaagtcagccagaggaaggaaaactgggaatgaagagtcagaggtgagaagctaaagtcatgatctcaccaagggatcaagaggtcgatattggcggcttgtgacggtaaacacggcaccatcctcctcctcatcccagacggacacaggggcctggaggagcaaggaaggggaagtcagacagttccacaccaccccccattgccctcagccttcaccccaggccctgctcctccctctgtacccctcacctgtggtggcagggcatagtaccagcgagtgcgaggaagggttgggggagctggtgaccccaggtctcccccactggggcccagacagccccaccccagccgcctcagggccccggtggagtcgaaggggctgcagtggaggcgtggatggagtacaggaattctgatcctggagacccccaaagccccttctccccagagctgaacccacacacgacagagaagcagggtacaaagggcaggagagggaagcgagaggcagcaagccagaggcagcgactaggggtagctgaaacctcagtccaggcactgccgcatgccccgcccctcccggccaaggactataccagcccagagaattagtctttttcaggacccctttcaccctggtccctcgggtagcgcctccactatctcagccctaagggacccccgaaggtagcagctccaatcccagtacaggaaggaaaaggggaagtgggatgatagggggttgggggcggtagactcagagagtcacgtggccccagcccctcccccgaccgatcccgaaaaaccagccctgccagtcaacctgccctcacctaggatctggacctaggagtttagggcctcggggccccaaatccaaattctggcccctcctgaggcccgaaatcctgctcctggccaccaccattaatccctaatgaaaacagatgaccactctctacccaccctaggatctttcctccaggtcccagaaccgtggcttcccggcctctacccaggaccggggcggggcgggggggcggggggaagggggagagagggaaggaggggtcacgaaatctgagggttccctccccaatcccagagtcagaggagctggttactgtggaaacaaacccctccccgccaaacaaaaacaaggagggagacagggaccaagacacgactgctcagagaggtaggcacactcaggcaggcagaggtggagggccaaagacccgcagggacaggacagccagccagaagttccaggcaggaacagggcaggttcctgcgggcaggtcctgagtcacactgacagagaaccacggagacgccaggactccccgcagcagagaaacgggccgacacccagggaggcgcgagaataactgaggcaaggaggaggagatgtagggacccagagacaagagaaaa

SEQ ID NO: 3709 - DNA, 576 bp, Homo sapiens
tagcaggaaggttcagggccctgcactgttggggctgctcagacatttgtgcaagggaggtgttttgttttggtgtttccatcacactcacagtgatttctccttttccccctttagtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccct

SEQ ID NO: 3710 - DNA, 641 bp, Homo sapiens
gtagttgtatcttaaaggaagagtgaataagagggagaaaatagttacatgtactccctccttacagcctagaaaaaatgacagatctcgtagctgtttgggatgttgctttaagtgacggagtccacaagatcgaatttgaacatgggactacatcaggcaaacgagtagtatatgtagatggaaaggaagagataagaaaagagtggatgttcaaattagtgggcaaagaaacattctatgttggagctgcaaagacaaaagcgaccataaatatagacgctatcagtggttttgcttatgaatatactctggaaattaatgggaaaagtctcaagaagtatatggaggacagatcaaaaaccaccaatacttgggtattacacatggatggtgagaactttagaattgttttggaaaaagatgctatggacgtatggtgcaatggtaaaaaattggagacagcgggtgagtttgtagatgatgggactgaaactcacttcagtatcgggaaccatgactgttacataaaggctgtcagtagtgggaagcggaaagaagggattattcatactctcattgtggataatagagaaatcccagagattgcaagttaatgaattttcatcttaagaagtaaa

SEQ ID NO: 3711 - DNA, 949 bp, Homo sapiens
ctctgcccgctcggttcctcagctcctcttcgtgtctttcccccgcggtggcgcggccctgcaccccacgcgtttgcggctgcggccggcggccgctctgctgggctccgggcgctgcagctcccggcgggcgtgtgcagcccgcagattcaggacgacccggctgcccggcttagcgcctttggagctccgcgctgaaggggccttgctccgcacaggcacggcacgcaagcttttggggtgcccagtggctctgttttcaagtcacagccggcccgcagggtgcggacctttccacatctcacttgggccgctagaaaatagaagaggcttcgtgacggagttatcagagacattgagaggcaaattcggaaaaaagaaaacattcgtcttttgggagaacagattattttgactgagcaacttgaagcagaaagagagaagatgttattggcaaaaggatctcaaaaatcatgacttgaatgtgaaatatctgttggacagacaacacgagtttgtgtgtgtgtgttgatggagagtagcttagtagtatcttcatctttttttttggtcactgtccttttaaacttgatcaaataaaggacagtgggtcatataagttactgctttcagggtcccttatatctgaataaaggagtgtgggcagacactttttggaagagtctgtctgggtgatcctggtagaagccccattagggtcactgtccagtgcttagggttgttactgagaagcactgccgagcttgtgagaaggaagggatggatagtagcatccacctgagtagtctgatcagtcggcatgatgacgaagccacgagaacatcgacctcagaaggactggaggaaggtgaagtggagggagagacgctcctgatcgtcgaatccgaggatcaggcatcagtggacttatcgcacgaccagagtgggg

SEQ ID NO: 3712 - DNA, 575 bp, Homo sapiens
gctttcgcttcatcctagaggctaaatgggctcccctggactcgcctggcagaactaaccacctagaagaacgttattgtaagggggaaatgcaaacagggtgaagacaagaggcataggtgatggacactaaaacaaagaccctgccacccaccgggagggaagtgaaatctcacctcaacaagtgagtccgcagagcgagaaccgtgcgacagtgcgtctgccaatacctggaatgtaggtgttcgttgcagtgtggccttcccagccggcctctcagcacacccggccaggcagccagtgttcccagaggacacgctggggccagacgtggaggaccccggccacctcggggagggaaagagaccaagaaaagaacctctgtagccttgcttctgagagtgcaggtttgttacaggcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaaca

SEQ ID NO: 3713 - DNA, 5030 bp, Homo sapiens
gacacactcctctacaacaccagagactcccaaacacaaggccttatattgactcatttcagctcacatcctggcgactctcaagagagaaacctcagagtgactaaaatctccataatgagaagacatgtacattcagtatctattttggcattttccccaatacatctctgctcatctgactcttatcttggcatctgcttcctggtggatctgaactgacccataagccacgcttactagtgattttccagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccatgctggctctgatggctcttattagtctgtatttataaaggcacacagtcctattgtagcttatctttcgttattttactgcagagcatctagacaacttagtccctccagcgggaaagtagcagcagcagcattagtcacaggtcttacactacagatcttgtgaaagagaccagtttggtactaattatgagcattttattcaaacaaaagtttttgaaatattacaactggggatttaaaaaattgcagcttagaatctgatggtttttttttttcttgatgttgtttgtttgtttttgagatcgagttttgctcttgttgtccaggctggaatgcaatggcacaatctcggctcactgcaacctctgccttctgggttcaagcgattctcctgccttagcctcccgagtagctgggattacaggcacctgccaccacgtccggctaattttttgtattttgagtagagacggggtttcaccataatggtcaggctgttctcaaactcctgatctcaggtgatccacccatctcggcctcccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcaaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcactctccctaagccctctgagagagatgaagatagatgattttattgctactaaattgaagggagcactatttctttttgtcttttgttagcaaaaaattgcaaaaagaattgtacattcttgctaaaaataaataaataaataaaaaattaaaaaaacaagggacctaacaaaactcagcagtgttactgtatttttaaaaaatatttttatagactcattttcaggttattaaatgtaagagaaacagatacccctcttttttaaagtaggtaaatcattgatgatttatattaccaatttttagaagtaattttctagtaagcttgtggcatcagaaaatactagaagatttttttagttaaattagttagaacatttatgaatgaatataataaatattttttcagaataaaatatggaccctttgtgtttactaatagataaagccagatataattttttgtttttaaggccacaaaatatggcctttgttaaagaacactaaagttagaaatctaaagttagagcaactttttaatggctatttcctattattgtaagtgttaaaacccctgcagaattcttgataaggtgctatttatactatatttcttattataagataactgtctttagtcttcttagtactagtctttttagtactaaatcaatcagtaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaacttggttgaaaagctctctgcagaagaagtgatctagactgacagaagtgttgctaattacaagttgtgttctcatgacgtaattagaaagtaacttctcaaagtacaacttttatgaaaaaaataagctgttaaaaaaaggaaatcgtaggttaatttaattgggaaaatgggcaattgacagagaccattttcctaacacatatatgtgctagtactttaactttttaaaattttacttctacgttttgtaatataaaaatttctattttaagtttagaatgttatacgtaccgaaagtatgcagccaaatcgatcagatcaaaccattttacctggagtttggtactggtttttacttctctgaatctgtataagaaaaataaagacaattgaacttcca

SEQ ID NO: 3714 - DNA, 849 bp, Homo sapiens
attttaggcgccattttcgagtgaaggacccggagccgaaacaccggtaggagcggggaggtgggtactacacaaccgtctccagccttggtctgagtggactgtcctgcaggcacgtctagattttcccacttacataggtcttgttaagaaaccagtcctgccttcttgccactcgtgtctttcgatggctcccttcccgaagtcccgctgcctctaagcggagtgttaagcggggctctcggaagccggtggaccgagatttccccgggtggggcgggcgcggtgtagcggcccgcgggctgacttgctcccggctgtcccccggccccagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataag

SEQ ID NO: 3715 - DNA, 623 bp, Homo sapiens
gggggcgactttgtggggagcctagctgctgctgggcgtttaccgcgggagcccttagcggtctggagcttatgtggagaagtcgctgtgaagccacctataaatccatttactgaatttatggagaaggctgtaaatgatggaagtcattcagaagaactcttttgccatcttaaaactatatcagagaaagaagatttaccacggtgtaccagtgaaagtcatctcagctgcctgaagcaggacattctaaatgaaaagactgaattggaagcaacacttaaggaagcggagttggtaactcattctgtagaattgcttttgccactatttaaggacaccattgaaaagattaattttgaaaatgcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtga

SEQ ID NO: 3716 - DNA, 3296 bp, Homo sapiens
gagcaactgccggcctccgcccccagccgcagccggtcactggcggcgccttccgcgccaagcttgggggccttttcggggtcctacatggcacggcttccgacccccggcccgggacggggctcgcaggccccagaggggcaggctggagaaggaggaggttaggtgtcttcaggagggttgctgagcccaaggacgcgccatcgccgcggagaaggagccggaccccttgggcggagcgcccaatgtgtggtccctcacgccgtcccgcaccttgctttttagggttctttttccgctttctgagcccttttataccttacgtttagaaggggaaaatcatcctcccacaccttctccccgactttttgccttttttgtcttgaagttacccaaaggtctgtgtattgttctcagtggtcccaagaattactcgaatatagttgtttttctgagggaggatggatggagataactatcctgatcccagtgtcactttttaaggcattcgcttcaagagacaagcagtttagaatcaggcagaactggattgcaaaatttatgggcagaccggaaaatgtctaatcaacaggagaagtatgaagctcagaatatagtcaattcaacagaagagagtgatgatgcttttgatactgtcactattccagttccctcagaagagcctcaagagtcagatcaaactgaagagcatgaatctggaatagaacaattcagtgagagccatgcaatacatgttgaggagcagagtgaccaaagcttttcaagcctggaaccagacaatgaacaactcatggaagaggttatatcaccaagacaagtttcatatactccgcaacatcatgaaaagcaatatgcaatgcagaggccaaatgatgatagtttggcatttctggataaaataaagtctgtaaaggaatctttgcaagaatcagtggaagattctctagcaacagtaaaagttgtacttattccagtgggccaggaaattgtaataccttttaaggttgataccattcttaaatatcttaaggaccatttttcacacttattaggtatcccacattctgtactgcagataagatactcaggaaaaattcttaaaaataatgagactctagtacaacatggagttaagccacaggaaattgtacaagtggaaatcttttctacaaatccagatctgtatccagtcagaagaatagatggattaactgatgtctctcaaatcataactgtcactgtccaaactggacttgatcaataccagcaggtacctgttgagattgtcaaatctgactttcacaaaccatttcttggtggattcagacataaagtaacaggagtagagtatcacaatgctggaacacaaactgtacctaaaaggattcccgaaagactcagtatattttgtagggatacgcagacagtttttcagaaaaaaaatctccaacaaactacaaatacaacatccacacagatgactaacattggtgtatatgtatcaaatatgactgataaactggtaacaccaggaaagtatttttcagcagcagaataccatgctcaaagactaaaggcggtgatagtgatacagacttactacaggcaatggcatgctaaaatcttcgtagagaatttaagaagacagaaaagcttaagactggaatgggaaacacagcaagaactaaggaagataagagaaaaagaagaatggataaaattggactatcaccggaggcataatcctaaaacaaatgaagattttgaatttctttataatgcattagaattctggcggcaagaagaacttacacgtattaaccaatcttttactggagctgaaaggaaagctgctctgtgtgaacttctggaaaaagagactcagataattgcttccattgggagacatagatacattgcttatatggcaaatcaggaagcagcaatacaagcttttttggataagtgttcagctccaaaaatatggagaacccctaatggcaaaacaattgagatggatacgcagttcaccatcagagccagagagctgcaaaatatctataagtgcattatgctgaaaaatatctcccaagatgagaggctggatgtgctgttaactcttaaacacactgtaaaggaacatgaatgtaaactaactcaggaaattctagaattgattgacagagaggttgaccttatgatgagaggagtcaaacatcataaccttgaaggactcagaaaaagaattgcgacactcttttttcattatatcaaaacacctctgtttaatcctgaagttgcaaaataccttaaggtccctcaagacccattgaaattttataagaagatttacttttgccacagttgccagctttatttgccttctacagaattttctgtatcatccacctcacgccgcatataccggtgtcgtaactgcattaaccttcagaatgaggctcaaaaacgagaatcatttttgaagtacaaatgtttacttcaacagctctactatacagaagctgattatgaagatgattctaaaattgctttcttgatgcagctacaagacattcagtacctgacagagaacatctgggcgtcccagtcagtcctcagtgcttgcgacaatctcagtgatctggtcatggtcagatggaataaatccctggagtggtccccctggaactgcattcttcttaccaaagatgaagcagctgctcatctcaagctaacaagtattgaagagggatatgaacgctcatttattcacaagatcaaacacaaacatatcctggctaagaactatttttctcaggttccagtgctggcttcatttatacttgatgatggtgaaattgatgagatcagatggaagtatcactcagacacaacacctaagattatagaatcccagaggcctcctcattaggtgatccaggagtatttgtttgatgatcggcattttgttcactgctaatagggtaatacagaggtcacagagtatggaaatggaatttaatctgtttattgattttgttttttgtttttcatagtattttgagttatataaagagaaaacatttctatataagtaagtattctttgttaggaagttggtgctaaattgaaatgcaattttgttactgaaattaatattttggggtaaagaaaacattttaaaatgtgttttcacattaaattttttaaattttttcaagtatattagagttaaaatctaacaaacagccaaataaaaactagacaactttcaa

SEQ ID NO: 3717 - DNA, 2291 bp, Homo sapiens
aaaaggggcgggcgagcacggcccgcgggcggcgttcgctggagctggtggaccgggcggctgaccgaggggcggacgcgcggcggggcagaccgctggggactgcgggcggcgctgtgtccgtcgccatgacagatcagacctattgtgaccgcctggtgcaggacacgcctttcctgacaggccatgggcgcttgagtgagcagcaggtggacaggatcatcctccagctgaaccgttactacccacagatccttaccaacaaggaggcggaaaagttccggaaccccaaggcatccttgcgtgtgcggctctgtgacctcctgagccacctgcagcggagcggtgagcgggactgccaggagttctaccgagccctgtatatccatgcccagcccctgcacagccgcctgcccagccgccacgctctgcgtaagttccacatcaccaaccatgcatgcttggtgctggcccggggagggcaccccagcctgccgttgatggcatggatgtcctccatgaccacccaagtctgctgcagcccaggcctggcatcccctctcgcctcagcccctccccagaggccaccctctggccccgaggggagagtgtggcaggcacaggcagtgcagatgttggtctctgtctcccactttctcccccttcctccgtctctctctcatggcagttttcacacagcatggggcatcttatacgtccactcttgcccttccttttctaacctcattccacggggatcccttcatgtctgtgtggacagcaaccttgttcccacagctgcatggcgctcctaggcggtcccagctggaattacccaaccccatgacggaccctttcattgcagcgatctgcacacgtgtgggtgtttccataggacattgtcaggcacggatggctggtccgaagcacgtgcatttcagttttgaggctcctgtcctcaggcagtgtggactcaggccctgggagtcatgtggatgccagtagcctgggcccacagagctgctgggatgtggggggcatatcaagttgaagatggcaactctgatctgacgcctctgtgctcagggcccctggaggaggggctactgccccttggcccttagacaacaggacagagaccagagggactgggcggcttgtcccaggctactgggctgtggtctctgaccccctggaggcctccccacgcctcacagaacacagtgcagacggtgggcggggagagctcgaggggaggcccagccctgcaggtgggactggctctccctccccagccacgagtatgccacagggggctttcaaaaccaggcagggccaagccttggccccactggaggtagagcaccttctgtggctcccgggtgcctttaggcccgtccaggagttggagcagaggagaagacccagactgtgcatagttccctgaggagggctagcctcaggtgccacagcctggttcggcctggcggccccaggaggcagcagcaaccttgggcttcctgcggggtgactaccttgccctccggccctgcccgttgactaactatgctctgtggttttgtttccagagaactcagattgcacagagctagactcgggcagccagagcggcgagctgagtaacaggggtaacacctccctgctgcccctccctctctctccctctctctccctctctctttaccctccccagggctccatctccgcctcaggggcttctccaccccaagtctggctccattcctggccttctgttggtgacagaccccccccctaaggtgctcgtttgggggctcttcaggcagcacctcagcctggcacccccactcccctgcgcagcccccaggcctcaggaccccacccctctgaggcccaggggagccctgttcacgctggtttctccccaggacccatgagcttcctggctggcctgggccttgctgtgggactggccctgctcctgtactgctatccgccagaccccaagggcctgccagggacccggcgcgtcctcggtttctcgcctgtcatcatcgacagacatgtcagccgctacctgctggccttcctggcagatgacctaggggggctctgacagaccctggacccagggcctcacctgccactcaaccaaagagtcctcgagccggcccgccaaggggactgctgcttctttttctaaatgcatatttttcattatttataatttgtgtaaaaaacacaccttcaccttacaaggtgctgaccatattaaatgttcaggttctctc

SEQ ID NO: 3718 - DNA, 2390 bp, Homo sapiens
aattgtaaatatctttaatgcttggaggttaagagaaacttgaactttgtagtaatggagattaaagctattctcaagattaggtatacctattcaataaaagaaaggaatatttgggagtattggggataagagaagctagacattgtgaattcaaggaaaaagaattatgagaggaggatgcattttagtttattttgtgattaaaatttttttagtttttgttgttttgacatgtgacactgtaattttggctataataaatgacagaatgtatcatttggtatattggttagggtttaggtagaaaattttttcctttatatagtgagtggtagcgtatacaatgtttgctcacttcggcaaagagtagctttagttttctgattagttataatagtgatgcttcccatcatttgatatgccttaaagtagtattttactcttgaggtattcctttaatccttaggtcttggagtactttatagatggtcattattttttatgattcctctgaaactaaaggcagagaatcacccaagcattacaaaaatgttgagcaaaataaaaattaaagcttggttcctgaacattatctgttttctggtaccacttaagaagtttcaaaggatgagaagactaagactaataactatttttttcttcatcttttctttcagtggcaggatgtggaaattgattttttttttattttcaccttaactgaatacttacttaattcttttgtttaaattgcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggatatattgatttgtcaaaaagaagagtttctccagaggaagcaatcaaatgtgaagacaaattcacaaaatccaaaactgtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcagacccatctattttggatagtttagatttgaatgaagatgaacgggaagtactcattaataatattaataggcgcttgaccccacaggctgtcaaaattcgagcagatattgaagtggcttgttatggttatgaaggcattgatgctgtaaaagaagccctaagagcaggtttgaattgttctacagaaaacatgcccattaagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggagcccaaagtggtcacagatacagatgagactgaacttgcgaggcagatggagaggcttgaaagagaaaatgccgaagtggatggagatgatgatgcagaagaaatggaagccaaagctgaagattaactttgtgggaaacagagtccaatttaaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatatttaactataggcttcttccttcttgtcaccagttaaaagcattttaatactaagaccctaattcttttatctttattttagtcttgatgtggaactgtaggagcaggtgaataaaggatctctataacagatcctttcaaaagaagagttttagagaaaataaatttaactttaaccacagtgaaagttgacccttagcgggacaaagccttaaaatgcattgaaagaattagatcggttctgtgccttttatctatttgagattg

SEQ ID NO: 3719 - DNA, 1603 bp, Homo sapiens
agtccgggagctgctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaaatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatat

SEQ ID NO: 3720 - DNA, 613 bp, Homo sapiens
ggacccgccctcaagttctggacaccccgggtgaagactgttaacgcggcggggattgggcgcctgcggcagcttgtgggcggtacccgagggagagttcgagtttttattggtgtggaaattaaaagaacacacatattttgactggggctttgatcaaccaaatgctaaaaagccacataaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttccttgccatagagctgtgctctcagcctgtagcagctacttcagagctatgttttgtaatgaccacagggaaagccgagaaatgttggttgagatcaatggtattttagctgaagctatggaatgttttttgcagtatgtttatac

SEQ ID NO: 3721 - DNA, 1915 bp, Homo sapiens; identical to SEQ ID NO: 3708

SEQ ID NO: 3722 - DNA, 574 bp, Homo sapiens
gttgtgagctgcggcagagactggtggctggaggagacgccggcgctggagagtgcgctgcgccgcccgccgctgagggaccgcggggttagccactgctggctgcttccagtgttcgccgagaggaagcccgggggagtgcgaccgcctcaaatccagccttcttgtttggtgggacgaccgtcggttctgtccgggaggaatgacggggtcaaggtgtggaaattaaaagaacacacatattttgactggggctttgatcaaccaaatgctaaaaagccacataaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttcct

SEQ ID NO: 3723 - DNA, 2068 bp, Homo sapiens
agcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagagcaggacgtgggagcagcagcaagaagtggtttcaaggaaccgaaatgagcaggggtcaacatgtgcttccctccaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggc

SEQ ID NO: 3724 - DNA, 681 bp, Homo sapiens
aaactcctggtacctaagcaccgatctgccttggagaacctgattctgagactccagcaggatgtcttatcaacagcagcagtgcaagcagccctgccagccacctcctgtgtgccccgcgccaaagtgcccagagccatgtccacccccgaagtgccctgagccctgcccaccatcaaagtgtccacagtcctgcccacctcagcagtgccagcagaaatgtcctcctgtgacaccttccccaccctgccagccaaagtgtccacccaagagcaagtaacagcttcaggattcatcaggagcatgaaaggataaggataattggctcacctcgttccacagctccacctgcatcttctcatcaaagccatccagggatacacagggagcttctttcctcttagcctgtgatcggcctgtgatgatctctgatagcaaaaggttttctttttgaggctgccatactgccactgtccaggtggagactgagcaaaggaagtcctgggctgtgccagctcccagagcttcagaagaaagagcagctctctccctgggaaccattagagaattctgttgatgttttctgtgtctgtctgtcccctgggcatgagcttccaccacctgtgcagttgtcactttcctttcactccctgaataaagaatctatgcatatatatttgt

SEQ ID NO: 3725 - DNA, 2330 bp, Homo sapiens
cactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaatacctgacttgcagattatttatatatagtcgatcttgtgcatataaaggaaccatagaaatgggcagtggaggattcgtccacacccacagcttctcaacgggcctgaatttggccaagaaaaacctttatgagcttgtccctctctggtcaactggttttttgttcgtttgttttttgagacaggtttgcccttgttgcccaggctggagtgcagtggcacaatctcggctcactgcaacctccacctcaggttcaagcaattgtcgtgcctcagcctccctagtagctgggattacaggcaccatgcccagctaacttttgtatttttagtagagacagggtttctccatgttggccaggctggtcttgaacacctggcctcaagtgatctgcctgtcttggcctcccaaagtgctgggattacaggcatgagccaccatgcccagcaggtcaactgtttttgcaagcatttagccagagtcatgctgtgctgttaatcagtgtcctggagaatgggttgcttggaaatcttggcgccccctcagtagtaacagccttggtttaagggcgcagagtggagagtaaatgcaagggctataacaagggcattcatgctgtgggttaagatccacaaatcgctaggaatgtgtatactctgggtagtaagtttgtagtattagaaggtttaatgacaagtatttgaagagctgaagttaagtgttgggaggccatcccttatgaaggacaatgaatggcaagtaaaagaccaagttctgttcctgggtccattaatttagttaaaaaggcaaagttctttcagcacacatatctgcatgcagtcacgtgctgcctaaggatgcttcattcaacaatgagcctcacagccgtgctacacaataagattataatactgtatttttactgtaccttttaacattgtgttacaatggcctacaagaagcttgtgtggatggctttgaatgtggcccaacacgaactaataaattttgctaaaacatga

SEQ ID NO: 3726 - DNA, 2737 bp, Homo sapiens
attagctgggtgtggtggcgcgcacctccaccagtagtcccagctacacggaaggctgaggcgggaggatggcttgagcctagaagtgggaaggcagcagtgagccgtaatcgactctgggcgacagagcaagctatctatcgcttaaaaaaaaaaaaaaaaaaaaaaaaaaaaaggtgacttgcacctacggagagcttggagaaaacacggacaagtggaattttcccgcggatcaggagtctaaagaggcagtgtgaaatcgctgttgtgcgcttgcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtaggaggagcaggaaataagattattcagctgattgaaggcaaagcctctgcttatgtatttgcaagtcctggttgtaagaagtgggatacttgtgctccagaagttattttacatgctgtgggaggcaagttaaccgatatccatgggaatgttcttcagtaccacaaggatgtgaagcatatgaactctgcaggagtcctggccacactgaggaattatgactactatgcaagccgagttccagaatctattaaaaatgcacttgttccttaaaggaaagtttcatttggccgggcgcggtggctcatgcctgtaatcccagcactttgggaggccgaggcaggtggatcacttgagctcaggagtttgagaccagcctgggcaatatcgtgagaccccatctctacaaaaatacaaattaactgggcatcctgtcatgcgcctgtcatcccagctacttgagaggctgaagcagaagaatctcttgagcccggaaggcagaggttgcagtgagctgagatcgtgccactgcactccagcctgagtgacaggagttaagccctgtctcagaaaaaaaaaaaacaaaaacccaaaaagtacttaaagtttcatttacttagctaggagaaagacttggttctcaaaataatacattttaagattaattgggtagaattagagttccacctttattcattgttgagcagtgatttatatttagttattatatttaggaatagaaaatagaattaaataatttaacttgattaatcaaccagaccaattttgacgtctggagaacttataaactcaatatgttatatttgttttcctgtatttaggtggagaaatgagaaaaagctttagttccaattgacagttcaggtcaatgttcaatgaacattcctatcttctaaaccagatttctctttttttttcctgagacggagtctcgctctgtagcctaggctagaatgtagtggcgtgatctcggctcactgcaagctccgcctcccgggttcatgccattctcctgcctcagcctcccgagtagctgggactgcaggcaccgccaccacgcctggctaattttttgtatttttagtagagaaggtgtttcaccgtgttagccaggatggtcttgatctcctgacatcgtgatctgtctgcctcggactcccaaagtgctgggattacaggtgtgagccaccgcacctggcctaaaccagatttctttagggcacaattttttctggaatctcactcttgtttttcacagtaattttaaaaacgtttctactccaattaagaatatatatgatgttattatatatgcttatgaaacagatttatgagaaaagttttttttaaataaattatttaatcctagctctttgttattcaccagctttttaaaaaagtgtttgaaaattatacattctcgactttggggattagtttattcttgtggcatcattataaggcttaattgtggaaagctaagtacttgcttctattccttccaatgagagattataacataaactattaaaattattctgctaatatacctagatttttatttttaggtctctgtccattgcttttaattaaaattatctgttttcaaatc

SEQ ID NO: 3727 - DNA, 3160 bp, Homo sapiens
gaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctgcacgtggctggaggacagtgtcagcaccactagtgggggcagctccccagtgaggtggctccctcctgcccccctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgta

SEQ ID NO: 3728 - DNA, 541 bp, Homo sapiens
aggcaggccacggagatacctcgtggaaggaggaacagcaagtgcatgggccgagtgtgggacttgcctggtgtgctcaaggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaagtttaaaaatca

SEQ ID NO: 3729 - DNA, 2505 bp, Homo sapiens
aatgctgccgtgcgccgcgggagccagggggcgtggggccatggtggtcttgcgggcggggaagaagacctttctcccccctctctgccgcgccttcgcctgccgcggctgtcaactcgctccggagcgcggcgccgagcgcagggatacggcgcccagcggggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactcaagactaaaaactaaaggcctgggcctgagaactgaatcaggtcagaaagcaacattgaatgcagaagaaatggcggacttctacaaggaatttttaagtaaaaattttcagaagcacatgtattataacagaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggatgaggaaaatgaagctcgggctggttaactgacttgctcagcgtcccatggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgatt

SEQ ID NO: 3730 - DNA, 577 bp, Homo sapiens
accgactgactcagtgacctcggggtcgttaggcctccacgtcctcgctggagctgcggacctcagtcgtccatccacacctcccccctgccgcccccgcccatctcactctcccaaccctgggcaccagggcaggtcgacagcccgaggcactcctctactgcgtttccaggcccaggagacccactccagcgccgcggttccttgcgacccggcagccgttcagcagacctcccattctttcctgcatcatcgggcattgtggaggcaccctacggtgattcctctcagagcctgtttgtagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgag

SEQ ID NO: 3731 - DNA, 542 bp, Homo sapiens
gttgtgagctgcggcagagactggtggctggaggagacgccggcgctggagagtgcgctgcgccgcccgccgctgagggaccgcggggttagccactgctggctgcttccagtgttcgccgagaggtaccgggggtgacagctccgggaccggccgaaaggcgaggaaccggaagcccgggggagtgcgaccgcctcaaatccagccttcttgtttggtgggacgaccgtcggttctgtccgggaggaatgacggggtcaagccacataaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaa

SEQ ID NO: 3732 - DNA, 2039 bp, Homo sapiens
atgaacttccaggcgggcggggggcagagcccgcagcagcagcagagcctggcggctccggggggcggcggcgctgccgcgcagcagctcgtctgcggcgggcagttcggcggcgcggggcccggggccgggggcggcggcggcccctcgcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgatatgtgccactgtttccaacttttcatcaacaaaaaggcctttccaactccttccaaattagaagaccagttggtgacacacagcacctctggacatgccccctgtgcggggccggaggcgggccgggccctgggactgctctcagatgagaagcggccgccgagctccccactccagagacccacgggaacctttgtaactaaccccacccccagggaaggctaggagcgccggagcccgcgctgggggctgccggggaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaat

SEQ ID NO: 3733 - DNA, 1760 bp, Homo sapiens
ccgcagctgccttcggcgccgccagccccgccatggctgcgccctgcgcggaagagtgctggccctggggaagccccttcctcacccaggcttcacacatttgaccctggctctctctcaggaggacccctcgctggaaaggcattttaagggccaccgagatgcagttacctgtgtggacttcagtatcaacacaaagcagctggccagtggctccatggactcatgcctcatggtctggcacatgaagccgcagtcacgcgcctaccgcttcactggccacaaggatgccgtcacctgtgtgaacttctctccttcgggacacctgcttgcttccggctcccgagacaagactgtccgcatctgggtacccaatgtcaaaggtgagtccactgtgtttcgtgcacacacagccacagtgaggagtgtccacttctgcagtgatggccagtccttcgtgacagcctctgacgacaagacagtcaaagtgtgggcaactcatcgccagaaattcctgttctccctgagccagcatatcaactgggtccgctgtgccaagttctcccccgacgggcggctcatcgtgtctgccagtgatgacaagactgttaagctgtgggacaagagcagccgggaatgtgtccactcgtattgtgagcatggcggctttgtcacctatgtggacttccaccccagtgggacgtgcattgccgctgccggcatggacaacacagtgaaggtgtgggacgtgcggactcaccggctgctgcagcattatcagttgcacagtgcagcagtgaacgggctctctttccacccgtcgggaaactacctgatcacagcctccagtgactcaaccctgaagatcctggacctgatggagggccggctgctctacacactccacgggcatcagggaccagccaccactgttgccttttcaagaacgggggagtattttgcttctggaggctctgatgaacaagtgatggtttggaagagtaactttgatattgttgatcatggagaagtcacgaaagtgccgaggcccccagccacactggccagctccatggggaatctgccagaagtggacttccctgtccccccaggcagaggcaggagtgtggagtctgtgcagagccagccccaggagcccgtgagtgtgccccagacactgactagcacgctggagcacattgtgggccagctggatgtcctcactcagacagtctccattctggagcagcggttgacactgacagaagacaagctgaagcagtgtctggagaaccagcagctaatcatgcagagagcaacaccatgatcaggggagcaggaatcaggagctcggtggatttgcaggtggcaggccagggatttgtaccatgggacttgggtaaataaaggggactgaactctgtgggaatcacatccatactggagccctggatttttgcagttctgccctccaccttgctatctgcaccaggaggctctccacctggcagccagaggtccccagtgggccgggctcacacacaaatgatgcttcagacccgaatgagaggaccacattttgcttaatgtaaaggagccacttgaaaatgtctgctccttcggggtcctgagattgtggctccccctctggaggaggtggctccacgatgccttgattttcactcatcatttggacatgtgactggcttttcctacctctgccatggtgtagaaattgattgcacattgattggatgagc

SEQ ID NO: 3734 - DNA, 1915 bp, Homo sapiens; identical to SEQ ID NO: 3708

SEQ ID NO: 3735 - DNA, 572 bp, Homo sapiens
cattagagaagaagcaggcagcttgagacaggtggagctggatcaagctgtgaacgtgatttgctggaagctggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaag

SEQ ID NO: 3736 - DNA, 1654 bp, Homo sapiens
agtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattgccattcatcattgttgtataccctggagctggaaggagatggggactggttctcagccttgcctctcaccggcggagaactgaggccggaggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagctgcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagtgttctctcgacactgccagccccgtgttagcacctgggcctcagtcccacttgctcccaggcgccggttctgtggttggtttggaattaaagtcctgtttgaag

SEQ ID NO: 3737 - DNA, 2238 bp, Homo sapiens
gacatagcaagacctctgttccactgtgcaccactttatttgcttccacactcaccttgtagggaagaggcagaccctaagagcttgatttctaccttcaagtgaattctttacttcagaaacaactcaggttgctggttggatttcccttctgaaatatttaaaataatatttagaaaaaataatgtcagagcacagcagaaattcagatcaagaagaacttctcgatgaggagattaatgaagatgaaatcttggccaacttgtctgctgaagaactgaaagaactgcagtcggaaatggaagtcatggcccctgaccccagccttcccgtgggaatgattcagaaagatcaaactgacaagccaccgacaggaaacttcaatcataaatctcttgttgattatatgtattgggaaaaggcatccaggcgcatgctggaagaggaacgagttcctgtcacctttgtgaaatccgaggaaaagactcaagaagagcatgaagaaatagaaaaacgtaataaaaatatggcccagtatttaaaagaaaagctcaataatgaaatagttgcaaataaaagagaatcaaagggcagcagcaatatccaagaaacagatgaagaagatgaagaagaagaagatgatgatgatgacgacgaaggagaagatgatggtgaagagagtgaagaaacgaacagagaagaggaaggcaaagcaaaggaacaaattagaaattgtgagaacaactgccagcaggtaactgacaaagcattcaaagaacagagagacagaccagaggcccaagaacaaagtgagaaaaaaatatcgaaattagatcctaagaagttagctctagacaccagctttttgaaggtaagtacaaggccttcaggaaaccagacagacctggatgggagcttgaggagagttaggaaaaatgatcctgacatgaaggaactcaacctgaacaacattgaaaacatccccaaagaaatgttactggactttgtcaatgcaatgaagaaaaacaagcacatcaaaacattcagtttagccaatgtgggtgcagatgagaatgtagcatttgccttggctaacatgttgcgtgaaaatagaagcatcaccactctcaacatcgagtccaatttcatcacaggtaaagggattgtggccatcatgaggtgtctccagtttaatgagacgctaactgagcttcggtttcacaatcagaggcacatgttgggtcaccatgctgaaatggaaatagccaggcttttgaaggcaaacaacactctcctgaagatgggctaccattttgagcttccgggtcccagaatggtggtcactaatctgctcaccaggaatcaggataaacaaaggcagaaacgacaggaagagcaaaaacagcagcaactcaaggaacagaagaagctgatagccatgttagagaatgggttggggctgccccctgggatgtgggagctgttgggaggacccaagccagattccagaatgcaggaattcttccagccaccgccacctcggcctcccaacccccaaaatgtcccctttagtcaacgcagtgaaatgatgaaaaagccatcgcaggccccgaagtacaggacagaccctgactccttccgggtggtgaagctgaagagaatccagcgcaaatctcggatgccggaagccagagaaccacccgagaaaaccaacctcaaagatgtcatcaaaacgctcaagccagtgccgagaaacaggccacccccattggtggaaatcactcccagagatcagctgctaaacgacattcgtcacagcagtgtcgcctatcttaaacctgtgcaactgccaaaagaactggcgtaagaggcaacagagccatctagaagaacaagaaatggaaatagtgactcttggattacagcatggagactatgtcagcagcaatactttaggatccacgtggcagaactggaaacaatgctaccatctgataagggtatttgtaaaaggcagaatgtttgggccatgaagaagtaggggctgaagaggaaggtggaaggagataaaatataatatttagaggcaatattttctacttgcaatcaatttgagtgactcaggtgaaatttagagtcatatttcccgaagcagaagttaaagaaaattttttaaacatttgctttattattgttttcttctggtaaataataaatataacagaagtgttaactatt

SEQ ID NO: 3738 - DNA, 578 bp, Homo sapiens
aggatttgcactttctccttttcttcagaatgtgtatctgcctaagcagtgtgataacttttttcccagactggatcgatattccttagctggtcctgttgcagcaggagtccggtgactggagagaggaagctcttgggcagcattttccccaatacatctctgctcatctgactcttatcttggcatctgcttcctggtggatctgaactgacccataagccacgcttactagtgattttccagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagca

SEQ ID NO: 3739 - DNA, 660 bp, Homo sapiens
gggcgcgtcgaagatcttgtacctgtcgttcgcagtggctcactttcccaagccatgggcagcaggaagaaggaaattgccctgcaggtcaacatcagcacccaagagctttgggaggaaatgctcagttccaaaggactaactgttgttgatgtctatcaaggctggtgtggcccctgcaaacctgtggtgagcctcttccagaagatgaggatcgaggtcggcctggaccttctgcactttgcattagcagaggcagatcgtcttgatgtcctcgaaaagtacagagggaagtgcgagccaacctttctgttttatgcaggaggagaactggtggctgtggttagaggagcaaatgccccactgctgcagaaaaccatcctagaccagctggaggccgaaaagaaagtgctggctgaaggcagagaacggaaagtgattaaagatgaggctctttctgatgaagatgaatgtgtttcccatggaaagaataatggtgaagatgaggacatggtttcatcagagaggacctgtaccttggccatcattaaaccagatgcagtggcccatggaaagactgatgagattatcatgaagattcaggaagctgggtttgaaattctaacaaatgaagagagaaccatgacagaggcagaagtg

SEQ ID NO: 3740 - DNA, 581 bp, Homo sapiens
ctctctgctctcgcggccgactcgcaagatggcgccgcagaaagacaggaagcccaagaggtcaacctggaggtttaatttggaccttactcatccagtagaagatggaatttttgattctggaaattttggtaccttccctagtgaatatctagggttctcttccctagttttgcattttttctgttttaaaataggagcaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactcttgaac

SEQ ID NO: 3741 - DNA, 607 bp, Homo sapiens
acagccgaagggagcgggcgagcggcgacggcggcggcggcgggcacagattaattaaaagaagaatgaactataatccttgaagataactgggcaattttttaagtcggaggctgttcttactggtgtgaggatttacacacgtcttcagtttttcagcacagaccagcagaccatcatttttagaggaaatactccctctgccctcctttttggtttccttggtgaagagtgtaccatggaaaacctccagacaaatttctccttggttcagggctcaactaaaaaactgaatgggatgggagatgatggcagccccccagcgaaaaaaatgataacggacattcatgcaaatggaaaaacgataaacaaggtgccaacagttaagaaggaacacttggatgactatggagaagcaccagtggaaactgatggagagcatgttaagcgaacctgtacttctgttcctgaaactttgcatttaaatcccagtttgaaacacacattggcacaattccatttaagtagtcagagctcgctgggtggaccagcagcattttctgctcggcattcccaagaaagcatgtcgcctactgtatttctgcct

SEQ ID NO: 3742 - DNA, 580 bp, Homo sapiens
agttggctgggtccgggcttggggactgcaacgcgggtaagggactcagcctgggcttgccagctgtggggatgaggcgaagcatccatcctcttggcagttaagtggctggtcctgatctgagggatctgcaaatttggctcatggaaagaggtggctgaattctgcgtctcccattaaacggatactggcgttgttgatacgggtttcgcatggaccctgtcctgtgccagggtttttaatctagctattaaaggaactggagaataacaagtaagggttgcaaggtcgctgacaggcgtgggaaacttgtgaaggattagaatgctaagtggctttcagcttttttcacactaagtcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctgg

SEQ ID NO: 3743 - DNA, 2126 bp, Homo sapiens
atggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttccttgccatagagctgtgctctcagcctgtagcagctacttcagagctatgttttgtaatgaccacagggaaagccgagaaatgttggttgagatcaatggtattttagctgaagctatggaatgttttttgcagtatgtttatactggaaaggtgaagatcactacagagaatgtacagtatctctttgagacatcaagcctctttcagattagtgttctccgtgatgcatgtgccaagttcttggaggagcaacttgatccttgtaattgcttaggaatccagcgctttgctgatacccattcactcaaaacactcttcacaaaatgcaaaaattttgcgttacagacttttgaggatgtatcccagcacgaagaatttcttgagcttgacaaagatgaacttattgattatatttgtagtgatgaacttgttattggtaaagaggagatggtttttgaagccgtcatgcgttgggtctatcgtgccgttgatctgagaagaccactgttacacgagctcctgacacatgtgagactccctctgttgcatcccaactactttgttcaaacagttgaagtggaccaattgatccagaattctcctgagtgttatcagttgttgcatgaagcaagacggtaccacatacttgggaatgaaatgatgtccccaaggactaggccacgcaggtccactggctattctgaggtgatagttgtcgttggaggatgtgagcgagttggaggatttaatcttccatacactgagtgctacgatcctgtaacaggagaatggaagtctttggctaagcttccagaatttaccaaatcagagtatgcagtctgtgctctaaggaatgacattcttgtttcaggtggaagaatcaacagccgtgatgtctggatttataactcacagttaaatatttggatcagagttgcctctctcaataaaggcagatggcgtcacaaaatggctgtcctccttggtaaagtatatgttgtcggtggctatgatgggcaaaacagacttagcagcgtagaatgttatgattccttttcaaatcgatggactgaagttgctccccttaaggaagccgtgagttctcctgcagtgactagctgtgtaggcaaactgtttgtgattggtggaggacctgatgataatacttgttctgataaggttcaatcttatgatccagaaaccaattcttggctacttcgtgcagctatcccaattgccaaaaggtgtataacagctgtatccctaaacaacctgatctatgttgccggtggactgaccaaggcaatatactgttacgatccagttgaagattactggatgcacgtacagaatacattcagccgtcaggtaataacataaagcagtacaaaagaaaaataaatctaagagggaccaagtacataatcattattaatacactggaatttcaattttaaaatatttcaggctgggcgtggtggctcacgcctgtaatcccagcactttgggaggccgaggtggatagatcacttgaggtcaggagttcaagaccagcctggctaatatggtgaaaccccgtctctactaaaaaattatggccaggcgtggtggttcatgcctgtaatcccagcactttgggaggctgaggcaggccaatcacctgaggtcgggagttcgagaccagcctgaccaacatggagaaaccccgtctctgctaaaaatacaaaattagctgggcgtggtggcgcattgcctgtaatcccagctactagggaggctgcggcaggagaattgcttgaacccgggaggtggaggtcgcggtgagccgagatcgagccattgcactccagcctggacagcaagagcgaaactccgtctcaaaaataaataaa

SEQ ID NO: 3744 - DNA, 1780 bp, Homo sapiens
ctctttgaggctttctgatgcctagagtgagctcaactcaaaggtttccagcctcacactcgcctcacattcccccacagtcacattgcgctctgtgattctgaggaatacagtgtgccagcatccgatccagtctcctttcacctgcaggtgttccagaaacttcaaaatgcgtctggaagaactgaaaagattgcagaatcctctagaacaagttaatgatggaaaatattcatttgaaaacattcagcgagcatggcgagagtacctgcagcggcaggagcccctggggaagaggagcccgtccccaccctctgtctcctcagagaagctgagcagctctgtcagcatgaacaccttctccgacagcagcacacccgattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggtacggaaccagggccaggcgaggaccaactccacctccgcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtga

SEQ ID NO: 3745 - DNA, 2096 bp, Homo sapiens
cttctgagtgggggcggggactgctggagttgcggggcctgcctggggtagggcggggcaggacagcttggagatagggcccggaattgcgggcgtcactctgctcctgcgacctagccaggcgtgagggagtgacagcagcgcattcgcgggacgagagcgatgagtgagaacgccgcaccaggtctgatctcagagctgaagctggctgtgccctggggccacatcgcagccaaagcctggggctccctgcagggccctccagttctctgcctgcacggctggctggacaatgccagctccttcgacagactcatccctcttctcccgcaagacttttattacgttgccatggatttcggaggtcatgggctctcgtcccattacagcccaggtgtcccatattacctccagacttttgtgagtgagatccgaagagttgtggcagccttgaaatggaatcgattctccattctgggccacagcttcggtggcgtcgtgggcggaatgtttttctgtaccttccccgagatggtggataaacttatcttgctggacacgccgctctttctcctggaatcagatgaaatggagaacttgctgacctacaagcggagagccatagagcacgtgctgcaggtagaggcctcccaggagccctcgcacgtgttcagcctgaagcagctgctgcagaggttactgaagagcaatagccacttgagtgaggagtgcggggagcttctcctgcaaagaggaaccacgaaggtggccacaggcagagaacagcattgacttcatcagcagggagctgtgtgcgcattccatcaggaagctgcaggcccatgtcctgttgatcaagtaagtctggacccatccccttcagccacccgccaaggagacatgggcgccaggaatctccgggagggggccctggcatgaggctccaagttctctgcgtgtcgaccacatcgctaaggctcaagatcttttttgggaagcccccctggcagcagggtcatggaaggaggaaggtcagaggaggggagggctcgggcagcaggggatgggccggggctgtcccatgcctttccacaggtgtcagcggggggcatgcccaggtaaggctccataaccagtgagcccagtctcggctgactgcaacctctgtctcctggattcaaacgattctcctgcctcagcctcccgagtagctgggactacaggcgcccgccaccaggcctggcttatttttgtatttttagtagagacgaggtttcgccatgttggccaggctgctctccatctcctgacctcatgatccgcccgcctcggcctcccagtgttgggattacaggcgtgagccaccgtgcgtggcccaccatagacgatttttaagccataaaaagaaacgaagcactgacacgggctccagcatggatgagcctttaaaacatcgcgctaagtggacgaattcagacacaaccgtctacgtgttgtatggctgcattcacgttcaagtcaagtccaaatagggcacactgcagagacaaagccagagcagtccacggatattttgattcaagacagaattactctgagaaggagtccctgtcgttcatgatagacacgatgaaatccaccctcaaagagcagttccagtttgtggaagtcccaggcaatcactgtgtccacatgagcgaaccccagcacgtggccagtatcatcagctccttcttacagtgcacacacatgctcccagcccagctgtagctctgggcctggaactatgaagacctagtgctcccagactcaacactgggactctgagttcctgagccccacaacaaggccagggatggtggggacaggcctcactagtcttgaggcccagcctaggatggtagtcaggggaaggagcgagattccaacttcaacatctgtgacctcaagggggagacagagtctgggttccagggctgctttctcctggctaataataaatatccagccagctggaggaaggaagggcaggctgggcccacctagcctttccctgctgcccaactggatggaaaataaaaggttcttgtattctc

SEQ ID NO: 3746 - DNA, 439 bp, Homo sapiens
agctttgggagcttgggctaccctgtaacgtctaaatgcctgtgcactgtgggattgatgacctcccacaactggagcagccgggaacagctctgaccacagtggttccggggagaagcctttccaggacccatgtgtaggcacaactgttttccctgatcaggatacttgcggcactcaacagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccat

SEQ ID NO: 3747 - DNA, 3761 bp, Homo sapiens
attgtaactcttcctgtagaacctgttcatgtccagggtgagtaaactagggtagaaatgtcttcctaaaacagcctccggtgaaattcgtccttggattcaaagcaacttacttcctaggaagtatcaggcaaatcccaactgccctccattttagaaaggtctcttttctgggaaaatctgccactgagaactttgccctcctctccctgatgggaggaaggagtagaattagggaggtgtcactcaggagagttgctgatgtcagtagtgtgtcagccgtgggaggctcagtttgtgaaattgagttacacctaagtgtcttatgaaactcagttcagaactcaccggagctgccgtctgggaggggggagggcggaagaaccctgaggtttttcctcacatttctgtcccatttttggaacctctggatttaaagaaatgaaaacctcaagtttgtggagattttaagaaatggttattccaatggaaacagctggagaacttatatttccgtgagaaaaaatttgctgttgaagttcatgatccacgaaggatttcagtttcaagaagaacctttgggcaaagtggcttgtttgtgcaaacatggtatgctaactcttctctcatcaagtccatttgggtaatggcaattagtcagcatcagttttacttggaccggaagcaaagcaaagcaaaaattccttcagccaggagtttagatgagattgcaatggatttgacagagacaggaacacaaagggcctccaagctggtgacactggagacgaaaagtcagttcatcatggcaagtaatggcagtttaatctcctcaggttctcaagactcagaagttagtgaagagcaaaagagagaaaaaatccttgaactaaagaagaaggagaaactattacaagaaaaacttctgaaaaaagttgaggagcttaagaagatctgtctgcgggaggctgagctcacaggcaaaatgccaaaggagtatcccctgaacataggcgagaagcctcctcaggtcagaagacgtgtgggtactgcgttcaaattagatgacaacttgctgccgagtgaagaagatcctgctttgcaagaactggagagtaattttctaatacaacaaaagctggtggaagctgcaaagaaacttgccaatgagccagacctttgtaaaactgtgaagaaaaagcgaaagcaagattacacagatgcgatgaaaaagcttcaggagattgaaaatgcaataaacgaataccgaattaggtgtggaaagaaacccagccagaaagcaacagtgttaccagaagacataatcccctcagagagtagctctttgtctgacaccaccacctatgatgatcccagtgatgccttcacttttcctgggcagcgatcaagttcagtacctcattctccaagaattcttccccccaagtctcttggtattgagcgaatccatttcagaaagtcgtccatcaatgaacagtttgtggataccaggcagtccagagaaatgctgtccacacacagcagcccttacaaaactctggagaggcggccccagggaggacgaagcatgcccaccacgccagttcttacccgaaacgcctacagcagcagccacttggaacccgaatcttcatctcagcactgccgccagcggagtggaagcctggagtcccagtcccacctgctctccgagatggacagcgataagccatttttctccctctccaaatcccaaagaagcagcagcacagaaatcctcgatgacgggtcttcttatacaagccaatcaagcacagagtattactgtgtgacaccagttaccggcccctattacaccacccagaccctggacactcgcaccaggggtcggaggaggtcaaagaaacagaatgtttctacttcaaattcaggaagcatgcccaacctagcacaaaaggatagtttgaggaatggtgtttactcaaagagtcaggagccaccgtcttccagttactacattgccgggtacacaccctatgcagagtgtgacttttattacagtggtggttatgtctatgagaatgacaccgagggacagtatagtgtcaacccttcctaccggtcctcagcccactatggatatgagcgccagagggactacagcagatcctttcacgaagatgaggtcgaccgggtaccccataacccatatgcaactctccggctgccaaggaaggctgctgcaaaatcggagcacatcaccaaaaacatccacaaggccttagttgccgagcacttgcgtggctggtaccagcgggcctctgggcagaaggatcagggacacagcccgcagaccagctttgactcagacaggggatcacagagatgcctggggtttgcggggctgcaagtaccttgttctccaagcagtcgtgcatcctcgtactcttcagtgtcttctacaaatgcttctgggaactggaggacccagttaaccatagggctgtcggattacgagactccagcacattcttcttacaccagctgctatggcaatgtctataatcctttaccctctccaagcagacaatacacagaaatcagtcaactggatggtacagatggaaaccagctggaagacaacctggagagtagtgagcagagactcttttggcatgaagattcaaagcctggaacattagtctgaactgcagttggacctcctgaccaagcactgcgttctcacactagtgtgccttgcaaattgtatttgtcttccgagaggatgttcgttttagaaacctaaagacatcaaaggttgaagagaagacttagttgccctggaagtgaatcagtgaatcacacaccaagccccacaaagcccctaaaggaggatttggcctttcaaactctaggcactaacgtaactgtagggtctgcccacatgttgaagtattgccaagagaggactcagtgtgaagccttcatcaatagcaagcactttttaagggagtaaaagttgttaaaggcaaacctcaaaaacatgaaagggcattcaggatgtcccatggcaataagaacaggggaaatctcagagcacaattcagcaggatgagagaaggggaaccagaagctccggagtcattgctcacttcagagtttgaattcgtgagctgacaaagagtaacatgctctttctacacagacatggacaatttagacagtattggaaaattacttgaagctggattttcatgaagttctgaatgagtgtaaatgttttttaggatactataaagagtgatgtttttcataagcaccataaaatgggttctggaaaaactgattaccttagcatcctgtaatataacttatggtagcagattggggaaaatgaagcagcccactgaataattgacaaagtctgcttggagaacattctaaggtacaatatcatggagctcctttttcctttctccactaattgcgtgatgagctattgttctggctgttaattctccaactcggctgtcatttgaagtggcagacttaatatggaaagtttttataattatgagtttgaaaaagcattttaagatgatacagaaagtatccaaaacaacagaaaaaaaaagccacgtcattttagatgaattgcgtgccttaaaatggtgaacgttagaaaattaaacaagtctggattccacaagtagttccaagtcaccaagtgacaaaaacaaggttaacattaaaaaagaaaa

SEQ ID NO: 3748 - DNA, 648 bp, Homo sapiens
accgggagtgtggctggtttctgttgcctgttttgatactcttctcctggtgggtgtgtacactggcactgagctgcagtaggatttttccttggatagtctggtctggagctgggacagcagctgctgctgtggaaaggccagctggcaagatgatggaagaaatctccattatggtagcctatgacgcccatgttttcagccagctgcacgatgaagacttcctcactagtctggtggccatcagcaagcccaggtctatggtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattga

SEQ ID NO: 3749 - DNA, 2076 bp, Homo sapiens
aggtattgctccggagggtgttactcgttagcgtcagtttttcattaaagggcagtatttaaagtcagttggcaagcagtggaataagatttttgtaaagaaaccttgtgcagcatggattctctaccagatgaattttttgtgaggcatcctgctgtggaggatcagaggaaggaagaaactgagaataagctagaaaaatcatctggtcaactgaacaaacaggaaaatgacatacctactgatcttgtccctgttaacctactattagaagtgaagaagttattaaatgcaattaatactctaccaaaaggtgtggttcctcacattaagaagttcttacaagaagatttttccttccaaactatgcagagagaagttgcagctaacagccagaatggtgaggaaattgttcctgctttgactttacgtttcttgattacacagctagaagcagcacttaggaacattcaagctggcaattataccgcacaccagattaatattggttattatttgacattactgtttttatatggagtagcactcactgaaagaggaaagaaagaggattatacagaagctgagaataaatttctggtgatgaagatgatgatccaagaaaatgaaatttgtgaaaactttatgtctttagtttattttggacgtggtttactgcgatgtgctcaaaagagatataatggaggactgctagaatttcataaaagcttacaagaaattggagacaaaaatgaccattggtttgacatagatcctacagaagatgaagatttacctacaacttttaaagatcttcttaataattttatcaagacaactgaaagcaatataatgaagcagacgatttgtagttacctagattgtgaacgatcttgtgaagctgacattttgaagaacaccagttataagggattttttcagttaatgtgcagtaaaagttgctgtgtttatttccataaaatttgctggaaaaagttcaagaatttaaagtatccaggtgaaaatgatcagagttttagtgggaaaaaatgtttgaaggaaggatgtacaggtgacatggtaaggatgctgcaatgtgatgtacctggaattgttaaaattttgtttgaagttgtgagaaaggatgaatatatcaccattgaaaatttaggagcaagttatagaaagttgatatctctgaaaataactgatactgatataagaccgaagatcagtttaaaatttaatacaaaagatgaaatgcctatcttcaagcttgattataattatttctatcatctgcttcatataattattatttctggtactgacattgttcgacaaatatttgatgaggctatgccacctcctcttttgaaaaaagagcttcttatacacaagaatgtgctggaatcctactacaaccatctttggaccaatcatcctttgggtggatcatggcatctgctttatcctcctaacaaggagttaccgcaatccaaacagtttgacttatgcctcctgttagctcttataaaacatttaaatgtgttccctgcacccaaaaaaggatggaatatggaaccgccatcttctgacatctctaaatctgcagacatcctgagactgtgcaaatacagggatatcctccttagtgagattttgatgaatggtctcactgagtcacagttcaattcaatttggaaaaaagtttcagatattcttctgcgccttgggatgatgcaagaggatattgacaaagtgaaggagaatcccattgagaatatctcccttgattaccatcagctatctgtctacctaggcataccagtaccagaaatcatacagaggatgttatcctgctatcaacaaggaattgctctacagtcaataacaggcagtcagcgtattgaaatagaagagttacagaatgaggaagaagaactaagtccacctctcatggagtacaatataaatgtgaaatcacaccctgagatacagtttgcagaaattaataaagatgggacctcaatacccagtgaatcttcaacagaatctcttaaagatctccaggaa

SEQ ID NO: 3750 - DNA, 697 bp, Homo sapiens
ttatctgtctcctcgtttccttttccctctattctttctcccaccatctcgccctctcaccctgtaaccctcttacccacttcctccgactttaaataaaaggctgatctgaccttctttttgcagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcg

SEQ ID NO: 3751 - DNA, 1185 bp, Homo sapiens
tctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaagggtgagtgtggggctctgggaatcctctgggaggaccttggatgactttctgaccttccccaggcacgttttcagggtcatgatcctgcccccgcccgggggatctactgtcctcccagtcacacccctctccccgcaccgccttcctgctgtcttctcttcttcccagaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaaca

SEQ ID NO: 3752 - DNA, 1505 bp, Homo sapiens
attactacagggcaggaagggcacgttctcatcagcatggatcagctggaaaatgcaaaaatggagcacacaaatgcatctttcgataccttcttctgtgagacaagagctgggaagcatgtgcctagagcactcttcgtggacttggagccaactgttatagatgggatccggacgggccagcaccgttcactcttccaccccgagcagctccttagcggaaaggaggatgctgctaacaattacgcgcgaggccgttactctgtggggtcggaggtcatcgaccttgtgctggagaggacccggaagctggcagaacagtgtggtggacttcagggatttttgattttccgaagctttggaggaggcactggttcagggtttacgtctctcttaatggagaggctcacaggagaatatagcagaaagactaagctggagttctcggtctacccagcccccaggatctccactgctgtggtagagccttataactctgtcctcaccacccactccaccacagagcacacggactgtaccttcatggtggacaacgaggccgtctatgatatatgccatcgtaaactcggtgttgaatgcccctctcatgccagcatcaatagattggtggttcaggtggtatcttccatcactgcctccctccggtttgaagggcccttgaatgtagacctaattgaattccagaccaacctggtaccttatccgagaatacatttccccatgacagccttcgcccccatcgtctctgctgacaaagcctaccatgagcagttctctgtgtcagacatcaccactgcctgctttgagtcctccaaccagctggtcaagtgtgatcctcggcttgggaagtacatggcctgctgcctactctatagaggggatgtggtccccaaggaagtgaatgcagcaatcgcagccacgaagtcgaggcactctgttcagtttgtagattggtgtccaactggtttcaaggtgggcatcaacaatcggccgcccacggtgatgccgggtggggacctggccaaagtccaccggtccatctgcatgctgagcaacaccacggcgattgtggaggcctgggcccgcctggaccacaagtttgacctcatgtacgccaagagagcatttctgcactggtacctcagagaaggcatggaagaagcagagttcttggaggccagggaagatctggcagccctggagagggactatgaggaagtggcgcaaagtttctgaggcatgtatgatgggtgcaaatgaatgtcaagttaaaatggcatgttttcttttcaagccgttatatgcctagtgggtagttcccctgatgagcagaaaaatgaactcaaatcaggcaagactctaggttccacactaaattaagtgggtcagtaccaacaatgaacacattatttcctggtctactggtacaagtcagctctgctacctgggagcctttggaagcttagagtcctttgaactgctga

SEQ ID NO: 3753 - DNA, 2602 bp, Homo sapiens
accgactgactcagtgacctcggggtcgttaggcctccacgtcctcgctggagctgcggacctcagtcgtccatccacacctcccccctgccgcccccgcccatctcactctcccaaccctgggcaccagggcaggtcgacagcccgaggcactcctctactgcgtttccaggcccaggagacccactccagcgccgcggttccttgcgacccggcagccgttcagcagacctcccattctttcctgcatcatcgggcattgtggaggcaccctacggtgattcctctcagagcctgtttaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaa

SEQ ID NO: 3754 - DNA, 992 bp, Homo sapiens
cgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctggg

SEQ ID NO: 3755 - DNA, 465 bp, Homo sapiens
aggaagagtgaataagagggagaaaatagttacatgtactgtgagtagaatttcttagccctccttacagcctagaaaaaatgacagatctcgtagctgtttgggatgttgctttaagtgacggagtccacaagatcgaatttgaacatgggactacatcaggcaaacgagtagtatatgtagatggaaaggaagagataagaaaagagtggatgttcaaattagtgggcaaagaaacattctatgttggagctgcaaagacaaaagcgaccataaatatagacgctatcagtggttttgcttatgaatatactctggaaattaatgggaaaagtctcaagaagtatatggaggacagatcaaaaaccaccaatacttgggtattacacatggatggtgagaactttagaattgttttggaaaaagatgctatggacgtatggtgcaatggtaaaaaattggaga

SEQ ID NO: 3756 - DNA, 1196 bp, Homo sapiens
gcactggaggcagtgattttggggcagagaattttgcaacacgtggtagtgaactgtgaggagtttgaggggtctgaagactgaaagagtcgaatggtttgttggcaggacctagaagaatcccttaggatgaagctgagtcttaccaagagcagaacatcatgaagtcttgacagaatataaagaaggagttggaaagtttatagtctgtgtctgtgtggagtgttgcaggacgagtggaaatgactgtttccaagttcatggcaattcagaaggcccttcagccagactggttccagtgcctctccgatggagaagtatcttgtaaggaagcaacttccataaaaagggtcagaaagtctgttgaccgatcacttcttttcttggataactgtctgcggctgcaggaagagtcagaggttcttcagaagagtgtgatcattggagtgattgaaggtggagatgtgatggaagagaggctgaggtcagcacgagagacagccaagcggcctgtgggtggcttccttctggatggttttcaaggaaatccaacaaccctggaggctagactacgcttgctgtcatcagtcactgcagagctgccggaggacaagccaaggctcatatctggtgttagtcggccagatgaggtgctcgagtgtattgaaagaggagtggacttatttgagagttttttcccttatcaagtaacagagcggggatgtgccctgactttcagttttgattaccagccgaatcctgaagagacactactacaacaaaatggaacacaagaagaaataaaatgtatggatcaaataaagaaaattgaaacaactggttgcaaccaagaaataacatcatttgaaattaatctgaaggaaaaaaagtaccaggaggactttaacccgctggtgagaggatgttcctgttactgctgtaagaatcacactcgggcatacatccaccatctgctggtgaccaatgagctgctggccggagtcctgcttatgatgcacaactttgaacactactttgggtttttccattacatccgggaagcactaaaaagtgacaaactggcacagttgaaagagctcatccacaggcaagcatcttgagatcttgcaaatacaagtctcactcttcacactgagcctgtaccactgttgtaacatgggaagacgtgaagaaga

SEQ ID NO: 3757 - DNA, 1928 bp, Homo sapiens
ggcttcttggcgcgatgaggttccggttctgtggtgatctggactgtcccgactgggtcctggcagaaatcagcacgctggccaagatgtcctctgtgaagttgcggctgctctgcagccaggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaagtagagatgaggtttctccatgttggtcaggctggtctcgaactcctgacctcaggtgatccacccaccttgccctcccaaagtgctgggattacaggcgtaagccactgcgcccagccactgccatcatctttaggaagagagaagtgaccatgcctgaaccagtcattggcaagaggaacggtgttatggactgaatgttcatgttcctccagaattcatatgctgaagcctctgtccacacatgcacaccagatgagggccatgtgcgcacacgaggtggctgtctacaaggccagaaagagggctgtcaacaggaactgcgtctgctggcaccttgatcttgaacttcccagcctccagaactgtgagaaagaaatctctatggtgtaagccactagtctgtggcattgttatagcagctcgagaagactaaggcagatgggcttccaggactggcccagaccagccagggctccttgtagaaaaggctgatgccagggttggcacatggagggtacaaggaggactcgcctggagtatcttaaggaacctatcgaagaataatggcttgttccactggccaaagatgggacaatttgaacatcaaaagagatacttactgactccactcctgacttctgcttctgaaaaaatgaagtaggtgttttccctattcctcccactaagtacagttaacaaccctggatgttacatataaaacaaacaaaaagactccgagcgatggagagaaggcaccctagcctggctgggatcctcaggacctgaggctccacagagagaaattcctggaatctggaccccatggcccagtcaggttacacaaaactgatcatcacagatctgtagaactatacaaaagtgctaacattcatgattagggtctcagaaggtaaggaggaagagagtggaatggaaaaagtattcaaaaaaataatcactaaaggccaggtgcagtggcccatgcctgtaatcccagcactttgggaggtgggacaattgctttagaccttgcaactggcctgagcaacacagggagactcagtttctccaaaaaaataaaaaattagccgatcatg

SEQ ID NO: 3758 - DNA, 591 bp, Homo sapiens
aagtatgaaacaatgacgatttcatgatggctcattgttctttggtattgtgccttacgtgagctggggactaactctaaatcagtttttatttcacttaggtggttccggggagaagcctttccaggacccatgtgtaggcacaactgttttccctgatcaggatacttgcggcactcaacagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatgg

SEQ ID NO: 3759 - DNA, 1725 bp, Homo sapiens
cactaaactagcaacaggatcaaaagatacaacagttatcatatggcaagttgatccggatacacacctgctaaaactgcttaaaacattagaaggacatgcttatggcgtttcttatattgcatggagtccagatgacaactatcttgttgcttgtggcccagatgactgctctgagctttggctttggaatgtacaaacaggagaactaaggacaaaaatgagccagtctcatgaagacagtttgacaagtgtggcttggaatccagatgggaagcgctttgtgactggaggtcagcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcatgttttggaggccataatgaagacttcatcgctagtggcagtgaagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggaccagcaccttttatagaccaccagaatattgaagaggaatgcagtagcatggatagttgatggatgttggttcctgcaaacaagaactgaccctatcacctctgcctcacagtgggtaaatatatcatacatctcttgaaagggaaaatatccatgtcagtttctttcacagtagaagaatggctgcttttgaatggggaggaaagaagacatttttcttaatatcctttttgtcccatctctaaaatgtataaatattttgatttggttttactttaatttctcattcataatttcgcaactgtccttttgggttgccctccaacacattacttccatttcagaaaccatatctgatttaatataaactgctaacttaagaagaggtgaatttgcatttacacttagacactttctaaaaacagggtgaacttaattgaaatttttcagtgttgttaagctattgttatagtagctgccctatagttacaaaaataaaaactataaaaacccatcccctatctacttaatccagatagcctggatttaacaaaaccaatagtataaaaatgtgtgtgtgtgttctgtgtgtgtgtgagagagagagtacttgattcattaaaaagtcctggaaacagctgttctaggatcttgtcatttttactgaaagtctcgtgcacatgtgaagtgccctctgagtttaaggtttggttaatactggtatatttttataagattgaaattgtgtccccatctttaacttaaacattttcattatcagggtcaatgtgctagaactgaattgtaacatttttaggcacagatggaaaaaaatgttattggctccttgaaaatgtgtgtgtgtggcgaggggaatagatccacaaaagcatgtatgt

SEQ ID NO: 3760 - DNA, 2166 bp, Homo sapiens
ggcccgcggagtccagcgaagtttggcggaacatggcggaagcgtctggggcacgcaggagcgcggggcggcggcggccggagcccgaggagctgtagcagccttagtcgccgccgccgcggggcgaggtcgccgccatggcccgctggatcccgaccaagaggcagaagtacggggttgcgatctataactacaatgcttctcaagatgtggagctctccttgcagatcggtgacacagttcacatcctggagatgtacgagggttggtacagaggatataccctccaaaataaatctaaaaagggcattttccctgaaacatatatccatttgaaagaggcaactgtggaagacctggggcagcatgaaaccgtgattcctggcgagctccccctggtgcaggagctcacgtccactctgcgagaatgggctgtcatctggcgaaagctctacgtgaacaacaagctcaccctcttccgccagctgcagcagatgacgtacagcctgatcgagtggcggtcccagatcctgtctgggacgctccccaaggatgaactggcagagctcaagaagaaagtcacagccaaaattgatcatgggaacagaatgctggggttagatctggtggtgcgagatgacaatgggaacatcctagaccctgacgaaaccagcaccattgccctcttcaaggcccatgaggtggcctccaaaaggattgaggaaaagatccaagaagagaagtcaatcctgcagaacctcgatttgcggggccagtccatcttcagtaccatccacacctatggcctctatgtgaacttcaagaactttgtctgcaacatcggggaagatgcagagttgtttatggccctctacgacccagaccagtccacttttatcagtgagaactatctaattcgttggggcagtaacgggatgcccaaggaaatagagaagctcaataacctccaagcagtgtttacagaccttagcagcatggacctcatccggccccgcgtcagccttgtgtgccagattgtccgcgtgggccatatggagctgaaggaaggcaagaagcacacctgtggactccgaagaccttttggagtggcagtgatggatattactgatatcatacatgggaaggtggatgatgaagaaaagcagcattttattccctttcagcagtaagtactttggcatgtgtcccaggtgacttgagacctggattagccattcaattgtcttttaacacagaaacaggtgttagaaaccattttctcagagaaggaaagattctaagctgcaagattgtcagataggagctgaacagaagactttattcaaagtccttgatgttggactcccattgaagagggtaaactgaactttcctgattctatagaaagcatcaaaggaatataaaagggcacatatctgtctgctctggaatgcagagagggtgccgtccttgtgtcagcaatgccaaaatatatgtgcagtctattgcatgaaacaggcatcatggatgacacggaatcacgtgggctagcatagggcttctcagactgcatcatgcatatgaatcaggggaacttgttaggctgcaggggagttctgcctctgacaagctcccaggtgatgctgatgtagctggtctgagggccacactgtctgtagcgagggtttaggagatgagagagtgaagggctgacccacccatgggccagtgttcctgcatgttgggggaaagccagcctgggagcatgtgaaaggatccttgcagagctttactgaggccctccatattgagctgcaggagctggagccatgggtaggccattgaggagctgttgggagcagattcaagccgtgtcactctgaagaagtgcaggtgtgaacgtcatgacctgctccagcacctgcacaggcagtggaggcctagtggaggccaagagcattgccgggaccaagtcccaccaggggccatcgtgccagtcagagggcatcatctcagctcacttgcagctgccactgcagacaagtagaacaaactgagaattccacaaaccagccagagtcatatatttgagttaatatatcactttttacaaatgatatcacaaattagtggagaaagatacattatgcaaaaaaaaaaaaaaaa

SEQ ID NO: 3761 - DNA, 555 bp, Homo sapiens
gacctcccacaactggagcagccgggaacagctctgaccacatttttatttcacttaggtggttccggggagaagcctttccaggacccatgtgtaggcacaactgttttccctgatcaggatacttgcggcactcaacagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacaca

SEQ ID NO: 3762 - DNA, 549 bp, Homo sapiens
agcacctttgttcctactatagtcttcctttatttaagtcagttcatctccctctcgctttgcccacaaccttagctttgagtttagtgatctaagctccctgcctgctggtcactctctctctccagctaagccacagggtcactcttacttttgtcccttcacttggattcccaccactctctgagaaagttgctcagcttctctgtctcatctttacaccagctgaactctgttgtttctccctagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagc

SEQ ID NO: 3763 - DNA, 588 bp, Homo sapiens
gttgtgagctgcggcagagactggtggctggaggagacgccggcgctggagagtgcgctgcgccgcccgccgctgagggaccgcggggttagccactgctggctgcttccagtgttcgccgagagccacataaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttccttgccatagagctgtgctctcagcctgtagcagctacttcagagctatgttttgtaatgaccacagggaaagccgagaaatgttggttgagatcaatggtattttagctgaagctatggaatgttttttgcagtatgtttatactggaaaggtgaagatcactacagag

SEQ ID NO: 3764 - DNA, 1917 bp, Homo sapiens
agatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaatatttctgaggacaatcccagacccaggagatgttccagactcatttttctgatattcagagagggcaagagtcttggcctatgtcacacagcagagtccaggactccagaactccaacctagcactctggccagaaagtcagccagaggaaggaaaactgggaatgaagagtcagaggtgagaagctaaagtcatgatctcaccaagggatcaagaggtcgatattggcggcttgtgacggtaaacacggcaccatcctcctcctcatcccagacggacacaggggcctggaggagcaaggaaggggaagtcagacagttccacaccaccccccattgccctcagccttcaccccaggccctgctcctccctctgtacccctcacctgtggtggcagggcatagtaccagcgagtgcgaggaagggttgggggagctggtgaccccaggtctcccccactggggcccagacagccccaccccagccgcctcagggccccggtggagtcgaaggggctgcagtggaggcgtggatggagtacaggaattctgatcctggagacccccaaagccccttctccccagagctgaacccacacacgacagagaagcagggtacaaagggcaggagagggaagcgagaggcagcaagccagaggcagcgactaggggtagctgaaacctcagtccaggcactgccgcatgccccgcccctcccggccaaggactataccagcccagagaattagtctttttcaggacccctttcaccctggtccctcgggtagcgcctccactatctcagccctaagggacccccgaaggtagcagctccaatcccagtacaggaaggaaaaggggaagtgggatgatagggggttgggggcggtagactcagagagtcacgtggccccagcccctcccccgaccgatcccgaaaaaccagccctgccagtcaacctgccctcacctaggatctggacctaggagtttagggcctcggggccccaaatccaaattctggcccctcctgaggcccgaaatcctgctcctggccaccaccattaatccctaatgaaaacagatgaccactctctacccaccctaggatctttcctccaggtcccagaaccgtggcttcccggcctctacccaggaccggggcggggcgggggggcggggggaagggggagagagggaaggaggggtcacgaaatctgagggttccctccccaatcccagagtcagaggagctggttactgtggaaacaaacccctccccgccaaacaaaaacaaggagggagacagggaccaagacacgactgctcagagaggtaggcacactcaggcaggcagaggtggagggccaaagacccgcagggacaggacagccagccagaagttccaggcaggaacagggcaggttcctgcgggcaggtcctgagtcacactgacagagaaccacggagacgccaggactccccgcagcagagaaacgggccgacacccagggaggcgcgagaataactgaggcaaggaggaggagatgtagggacccagagacaagagaaaa

SEQ ID NO: 3765 - DNA, 2010 bp, Homo sapiens
gcgcagaggcgtcacgcactccatggtaacgacgctcggcccgaagatggcggccgaatggggcggaggagtgggttactcgggctcaggcccgggccggagccggtggcgctggagcgggtcataaataaagttcatcttaaggcaaatcatgtggtcaagagagatgttgatgagcatttaagaatcaagactgtctatgataaaagtgttgaagagttgctccctgagaaaaagaatcttgtaaagaacaagcttttcccacaagcgatttcttatttagagaagacttttcaggtccgtcgacctgcgggcactatcttacttagcagacaatgtgcaacaaaccaatacctccggaaggaaaacgatcctcacaggtactgcaccggggagtgtgccgcacacacaaagtgcggccccgttattgttcctgaggaacatctccagcaatgccgggtctaccgtgggggtaagtggcctcatggagcagtgggtgtgccagaccaagaaggcatctcagatgcagactttgttctttacgttggtgctctggccaccgagagatgcagccatgaaaacatcatctcttatgcagcctattgtcagcaggaagcaaacatggacaggccaatagcaggatatgctaacctgtgtccaaatatgatctctacccagcctcaggagtttgttgggatgctgtccacagtgaaacatgaggttattcatgccctgggtttctctgctgggctgtttgcattctaccatgataaagatggaaatcctctcacttcaagatttgcagatggcctcccaccttttaattatagtctgggattatatcaatggagtgataaagtagttcgaaaagtggagagattatgggatgttcgagataataagatagttcgtcacactgtgtatctcctggtaacgcctcgtgttgttgaggaagcacgaaaacattttgattgtccagttctagagggaatggaacttgaaaatcaaggtggtgtgggcactgagctcaaccattgggaaaaaaggttattagagaatgaagcgatgactggttctcacactcagaatcgagtactctctcgaatcactctggcattaatggaggacactggctggtataaagcaaattacagcatggctgagaagttagactggggccgaggaatgggctgtgactttgtcaggaagagctgtaaattctggattgatcagcagagacaaaagagacagatgctgagcccttactgtgacacgctcagaagtaacccactgcagctaacttgcagacaggaccagagagcagttgccgtgtgtaatttgcagaagttccctaagcctttaccacaggaataccagtactttgatgaactcagtggaatacctgcagaagatttgccttattatggtggctccgtggaaattgctgactactgccctttcagtcaggaattcagttggcatttaagtggtgaatatcagcgcagctcagattgtagaatattggaaaatcaaccagaaatttttaagaactatggcgctgaaaagtatggacctcattccgtttgtctaattcagaaatcagcattcgttatggagaagtgtgagaggaagctgagttacccagactggggaagcggatgctatcaggtttcttgttctcctcaaggtctgaaagtttgggtccaagatacttcatatttgtgtagtcgggctgggcaggtcctccctgtcagtatccagatgaatggctggattcacgatggaaacctgctctgcccatcatgttgggacttctgtgagctctgtcctccagaaacagatcctccagccactaacctgacccgagctctgccacttgatctttgttcctgttcctcgagcctggtggtcaccctctggcttctgctaggcaatctgtttcctctgctggctggatttcttctgtgtatatggcactaggaatggaaaagtggatcttcaagatattct

SEQ ID NO: 3766 - DNA, 1799 bp, Homo sapiens
agattgctagtttcctcacagagctccagtccacactcggccctgaacgcggagttgaatcagctggctgaagctgagtgcctctcttttcctttcttgggaacaggaaaggtgctgtggagaggaattggggcgggatcattcaggggaaggtgacagcagatggtgggaaggccggagtcagcaagccaagtgtcaggggcagagtgagcctcagaaaacagcagctgcccggtgccagagcaaggaaaggccagggaggctgggcggggcagtgtctgtgggacagagtggggcaagaacacacacggccgggcacagcctcttagccagctctccatgtcagtatgagcagtaaccagggaactgggcaattggcacatcagcctatcagaattcatgggaggttatttcttaagtgaaattctaaagagttaaaggatgaatttggacagtgatggaatggatgacatcatcagtcaagaatcctcattggatatggaggggaattataaaaaggcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaa

SEQ ID NO: 3767 - DNA, 2056 bp, Homo sapiens
cccggcgccagcggccgcgtcggcgcggatgtccccgcccgcctctggttcgggcctcagcgagattactggaggattagatccggatcccgtccccgggcagcggccgccgcggccagcgccgccccgcgagttgcgagctccgggctggccctgctctgacaggctcgccccgccccacacgacacgcctgccactcctgcccccaggtcgctgaagagttcgaaaccgtgctcagcaccgcgtttggggcatgtgagaccgagaggctttgggaaactgacgccgctgtgagaacgagtttagcggagtctatggacgctgcgagcttgtggccacaagagggcgccccggagcacggcccagtccccgcccccgctggatggggcccggcctcttcccagcgttcctcctccggccccaggtcaccgccagcacgcgcctgcttcccgtctgcgcgagtccacgcagctccccaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagccagagtggaggtcggtgaaataaagtgatgcaattagacccca

SEQ ID NO: 3768 - DNA, 597 bp, Homo sapiens
aatgtgtttgagaaaactgttttcctcggacatgcaggcgtggactccttacttcaggtaaggtgacagcagcttgacagagagtgccttccctcccacggcatttgggacgaggctgaaggaaagacacaggcggggttacgggaaacccattctctgcgccatctgggcaagctgaagtcagtttttccgctttctcacgagacacgtctgcctctatgaaccagcgcagccatctgggcaccacctacctggacacggccaaaggcgcggtagagaccttcatgaagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggag

SEQ ID NO: 3769 - DNA, 1755 bp, Homo sapiens
aggcgcagtcccgcgttccctcggcggctgccggcgtagtgagcccgccgccgtggagtgtagcggaaagggctcgccgtcctcctccgtttctcgctgcttcgggacgcgctctctgcggctctgtgagcgcccctgagcgccggcagcggccgcggtgggttcttcaggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaaaaaaacctgaaataaataaatgttagattg

SEQ ID NO: 3770 - DNA, 825 bp, Homo sapiens
cttgtacctgtcgttcgcagtggctcactttcccaagccatgggcagcaggaagaaggaaattgccctgcaggtcaacatcagcacccaagagctttgggaggaaatgctcagttccaaaggactaactgttgttgatgtctatcaaggctggtgtggcccctgcaaacctgtggtgagcctcttccagaagatgaggatcgaggtcggcctggaccttctgcactttgcattaattaaagatgaggctctttctgatgaagatgaatgtgtttcccatggaaagaataatggtgaagatgaggacatggtttcatcagagaggacctgtaccttggccatcattaaaccagatgcagtggcccatggaaagactgatgagattatcatgaagattcaggaagctgggtttgaaattctaacaaatgaagagagaaccatgacagaggcagaagtgcgacttttctaccaacacaaagctggagaggaggcatttgagaagctggtacatcacatgtgcagtggaccaagccacctcctgatcctcaccaggactgagggcttcgaggacgtggtcactacctggcgaaccgtcatgggcccccgtgaccccaatgtggccaggagggagcagccagaaagtctccgagctcagtacggcacagaaatgcccttcaatgccgtccatggaagccgggacagagaagatgctgacagagaactggcattgctcttccccagtttgaaattttcagacaaagatacagaagcccctcagggtgagtccagtacacagccaaggttgaagatcactgacctagactaa

SEQ ID NO: 3771 - DNA, 3844 bp, Homo sapiens
gcagtactccctgattggctctgcactggaggcagtgattttggggcagagaattttgcaacacgtggtagtgaactgtgaggagtttgaggggtctgaagactgaaagagtcgaatggtttgttggcaggacctagaagaatcccttaggatgaagctgagtcttaccaaggtagttaatggctgtcgcctaggaaaaataaaaaacctgggcaaaacaggggaccacaccatggatattccaggctgccttctgtataccaagactggctccgccccacacctcacccatcacacgctgcataatatccacggggttcctgccatggctcagcttacgctgtcatccctagcagaacatcatgaagtcttgacagaatataaagaaggagttggaaagtttataggcatgccagaatcactcttgtactgctccctgcacgatccagtcagcccctgcccggctggttatgtaacaaacaagtctgtgtctgtgtggagtgttgcaggacgagtggaaatgactgtttccaagttcatggcaattcagaaggcccttcagccagactggttccagtgcctctccgatggagaagtatcttgtaaggaagcaacttccataaaaagggtcagaaagtctgttgaccgatcacttcttttcttggataactgtctgcggctgcaggaagagtcagaggttcttcagaagagtgtgatcattggagtgattgaaggtggagatgtgatggaagagaggctgaggtcagcacgagagacagccaagcggcctgtgggtggcttccttctggatggttttcaaggaaatccaacaaccctggaggctagactacgcttgctgtcatcagtcactgcagagctgccggaggacaagccaaggctcatatctggtgttagtcggccagatgaggtgctcgagtgtattgaaagaggagtggacttatttgagagttttttcccttatcaagtaacagagcggggatgtgccctgactttcagttttgattaccagccgaatcctgaagagacactactacaacaaaatggaacacaagaagaaataaaatgtatggatcaaataaagaaaattgaaacaactggttgcaaccaagaaataacatcatttgaaattaatctgaaggaaaaaaagtaccaggaggactttaacccgctggtgagaggatgttcctgttactgctgtaagaatcacactcgggcatacatccaccatctgctggtgaccaatgagctgctggccggagtcctgcttatgatgcacaactttgaacactactttgggtttttccattacatccgggaagcactaaaaagtgacaaactggcacagttgaaagagctcatccacaggcaagcatcttgagatcttgcaaatacaagtctcactcttcacactgagcctgtaccactgttgtaacatgggaagacgtgaagaagaaataatctgagctttaattatttatatttggatataaggtctgcttaaataaagaatctttgtaccaaactgcccacatgagggtgaagagatttcctcaaaagacttaaatgacctggattgatcagagagaattgaactgtgacctttaagacttctagactaattcttttagttgatagagattcatttagtcaaagacaaaagctttaactgtgagggcacagccttgaagtgggagtgatgagattctgagggacccatgaattggattgaggcttgaggggaaatggtgtgagacgaatgggctctggacatatgcctgttgatttgagaagaaatctggctggtttgagggtttcctttagttcaccctcatactctcaggagactcttctggatacttttgtcttccaccctgccctggcagtgcagccaatcagaaatggctcttgtgacttaactgggcttggatatccctggaatgtggggcttgaacattgctcctgtgatgatcatctgtcccaggtcacactccttcatttgaccacatggcctatttgcaacttctttttagagccaatgtaattgcctgttaggagccagaagtttgcccagctgctttcttctggttgtacagatccattgtggtctgccttccaggctcattaatagtctaactacgtaataactgaagacctatctcttgtgaagattcattctcaatgtgttcacttggacagagccctgcctggcctaacgattagagggttagtctccatcctgctcagatatgactcctgggcaattcacttaacttctccatggctgcttcctgctgaataaatagggacaggcataatggataggaatgaatgaacttttaagatactgtctagctctaaaattggaagaacaaaaagttttagattagagtcatagccttaatagccctagttgtcatcctgggagacaggcaacagtagagatatttgagagcctaaagagaggtttggcctgtgggtttttaagtggttattgaattggtatcaggagatcctgaggctggtaggggaaggtaattctttctaagttacctctgtatttttcaagttttctataaggaatacacatacacccacatgcacacaccatagtttttatacaaacagcaataacaaaaccaaaaagatgcccctttttttgtagggataagaaatacatttgttttatacttctatgctatattttgctattcaaaatttagtgggcattacttaacattgtttctaattattttgtggctgctgtatgttttatgtgttgggagcccattgtattaggccgttcttggattgctataaagaaatacctgagactgggtaatttggttttttggttttttggggttttttttgagacggagccttgctctgtcgcccaggctggagtgcagtggcgcgatctcggctctatgcaacctccacctcctgggttcatgccattctcctgcctcagcctcccgagtagctgggactacaggcgcccgccaccatgcctggctaattttttatatttttagtagagatggggtttcaccgtatgagccaggatggtctcgatctcctgacctcatgatccacaagactgggtaatctgtaaagaaaagaggtttaattggctcatggctctgcaggctttacaggaagcatggtactggcatctgcttggtttctggggaggcctccggaagcttatagtcatgacagaaggtgaagggggagcaggcacatcacatgacaaaagcaggaacaagactcagagcaagaagtcacttatcaccaaggggatggcccaggccattcatgagggatccacctttgtgctccaaacacctcccaccaggccccacctccagtattggggattacatttcaacttgaggtttgggcgggaacaaatagtcaaattatattacccatctacatggttttctttttcttagtatgggagtgtccatgaataaattcatgggcatcctcataactcttccatgaatggcaaggggtacttatggaaaacagttttccaaagatctgattgttttgaaatgtgttagattggacttgttcaaatgttcatatttttgttctatgctaaatgcatcgttaggggagtagtggtaaatattccagaatccatatgaaattcatgagtttatttatgtctaaaacactgaaaactgtgtccaatatcgttcagtttcctgggtctttttcttattagcacatttgagaaaaatattcctttcctttattgtagtaaatctattaaaggcaatagccaataaaacatttttaattttaaaaa

SEQ ID NO: 3772 - DNA, 474 bp, Homo sapiens
tccggcgcccgcgaggccccgagtcctcctccggagggcggctgcgggcctgccctcttctcctaaccagacacgtctgcctctatgaaccagcgcagccatctgggcaccacctacctggacacggccaaaggcgcggtagagaccttcatgaagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgag

SEQ ID NO: 3773 - DNA, 503 bp, Homo sapiens
caggtagtgcccgctggagctcgcgcgctcatccggcaccactccagggctccaggctcctcgggcttccggagtcgagacgtgaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggcca

SEQ ID NO: 3774 - DNA, 2445 bp, Homo sapiens
ctctttgaggctttctgatgcctagagtgagctcaactcaaaggtttccagcctcacactcgcctcacattcccccacagtcacattgcgctctgtgattctgaggaatacagtgtgccagcatccgatccagtctcctttcacctgcaggtgttccagaaacttcaaaatgcgtctggaagaactgaaaagattgcagaatcctctagaacaagttaatgatggaaaatattcatttgaaaatcaccagctggccatggatgcagagaataatattgaaaagtatcccctcaatctacagcccttggaatcaaaggtgaaaatcattcagcgagcatggcgagagtacctgcagcggcaggagcccctggggaagaggagcccgtccccaccctctgtctcctcagagaagctgagcagctctgtcagcatgaacaccttctccgacagcagcacacccgattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggtacggaaccagggccaggcgaggaccaactccacctccgcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaactttgtttc

SEQ ID NO: 3775 - DNA, 524 bp, Homo sapiens
attgttctttggtattgtgccttacgtgagctggggactaactctgtatccttaaggaggcatcacttgattagagttgcccaaaagaatgtgggttattatcctaaaggtctgtgttgccatcctgaaacagtcagaaatcagtttttatttcacttaggtggttccggggagaagcctttccaggacccatgtgtaggcacaactgttttccctgatcaggatacttgcggcactcaacagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagagg

SEQ ID NO: 3776 - DNA, 3812 bp, Homo sapiens
agtgccccccgcgccccgctccggcagctccacgctcgcgcccgccatgccggagcagttcagcgtcgccgagttcctggccgtcaccgcggaggacctcagctccccggctggggccgccgccttcgccgccaagatgccccggtaccgaggggcggcgctggcgcgggaggagatcttggaaggagaccaagccatcctgcagagaataaagaaggctgtgcgggcaatccatagctccggccttggccatgtggagaatgaagagcagtaccgagaggccgtggaatccttaggcaacagccacctgtcccagaacagccatgagctgtccacaggcttcctaaacttggccgtgttcacccgcgaggttgctgcgctcttcaagaacctgattcagaacttgaacaacattgtctctttccccctggacagtctgatgaaggggcagctgagggacggtcgacaggattccaaaaaacagctggagaaggcatggaaggactatgaagccaaaatggccaagctggagaaggagcgcgatcgggccagggtgacaggagggatccctggggaggtggcccaggacatgcagagagagcggcgcatcttccagctgcacatgtgtgagtatctgctcaaagccggggagagccagatgaagcaaggtcctgacttccttcagagcctcatcaagttcttccacgcccagcacaactttttccaagatggctggaaggctgcccagagcctgttccccttcatcgagaagctggcggcctcagtacatgcactccatcaggcccaggaggacgagctacagaagctgacccagctccgggactccctccgagggacactgcagcttgagagcagagaggaacacctgagccggaagaactcaggatgtggctatagcatccaccagcaccaaggcaacaagcagtttgggacggagaaagtgggctttctatacaagaaaagtgacggaattcgaagagtctggcagaaaaggaagtgtggagtcaagtatggctgcctgaccatctcacacagcacgataaaccggcccccggtgaagctgaccctgctgacgtgccaagtgaggccaaaccctgaggagaaaaagtgcttcgacctggtgacccacaaccggacgtaccactttcaggcagaggacgagcacgagtgtgaggcgtgggtgtcagtgttgcagaacagcaaggacgaagccctgagcagcgccttcctcggggagcccagcgctggcccggggtcctgggggtccgccggccatgatggggagccgcacgacctcacaaagctgctcatcgcggaggtgaagagcaggcctgggaatagccagtgctgcgactgcggggctgcagaccccacgtggctcagcaccaacctgggcgtgctcacctgcatccagtgctcgggcgtccaccgcgaactgggcgtgcgcttttcgcgcatgcagtcactcaccttggacctgctgggcccctccgagttgttgctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctggccttcttcctgccacaggccatgcctctaccaaggacacatggcctttccctgttaggactgatggcggttctttcctatctcattacccgctaggggcctgggagccctgtggctggatctgagtgctcctgagctggcttcagctgcagaactctcagtccctcatcagatcgagactctatttcccccgtcagtctgggggcttcacaagggcaggagagccctccatcactgacttccagatcagggaccctgccaagtagggactgtcttctcagccagccatttattagtctaatattccttcactaaattccaactctatgtctggacctgtgttaggcacttcagataccacacgagtaagacaagggccctgcaggggtggtcctttggtggaaagctggtcttaagggttgggcttgggaataggcagggtcagattccagggcatggctctggactcagctggtttatacctatatgaccattacaattgtctacagatcacatccattctggctggtcaacatgcatgctgtactggctgttaaataaaaatattctgaatgtcactccttttgagggacagcacagccttccctaggcattctcctatattccccaatgagaaagcagatacacctaagccatcatcaaccactaacatctcaacttgccagttgctgggtgctgggccctggcaggaatgggccaagccaagcaggggagactagagagcaccaatggccaacacagctgcctggctggggaggctgtgctgtttcccctggagacctgactggtctgtggttcccacaggaacagggttgtcttttgagcccccagtgtctggtttcattcatctcagacttgttatttcactcatctctaataaaggattggggggtcagttt

SEQ ID NO: 3777 - DNA, 583 bp, Homo sapiens
ttttaggcgccattttcgagtgaaggacccggagccgaaacaccggtaggagcggggagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggat

SEQ ID NO: 3778 - DNA, 7917 bp, Homo sapiens
gaagcttgaagacattatgctaagtgaaataagccagtcacaaaagaacaaatattgtattatttcagttatataaagtttctagactagtcaaattcatagaaactaggatgatagttgctagggtcagggagaagaggggatggaaaggtattgtttaatggatgcagagtttcagtttgagaagatgaataaaagaaaaaaatgacattaaattttgtcaagatagcatattgaaaatataatagaaaaatatttgtttatctgctataatatattatgtcataggtgttatcttcaggaaggcacactggacctgctaaattaacaaatggaaagaaagcgtaagtacttgaagacgtttacaacttcagatttcaaggaatttttcaggtctttgggctggatgacatgtcgtctaccccagaaaattaggtaggcctctaccatcacaagctctgaggaacaatttttcatgtctacccatgttaatcattttagtatttaacagtctttctgatcttcagaatgtgtttataaattcatcttgtacatggttggacaagctttcttgtctttgctggaaagaaaatgactacttactaatatattttgggaaaaatatttgtaagaatattaataagcttgttttccaggacctatttaagaaaaataccacgttttaatgcagattctggctattccatccattctgattcagaaagtcaggtaagattgaatagatacaatacacactattttaattagttttcaaatagtagctaaaaagtaggaataaaatgcaaagtattaattgctctaaggaagtatgaagtctgttgctttaaaacatcttttctaccaataatagtttgtaaataaacaaattttaaaactacataatttatattttttcctacactaacagtcatatacaaatgtattctaaatgactttatttcttacaggctgaaactgtacacgggcttgatggttgtgcttctttgctgagggacattttgagaaatgaagattcaggttttttttttttaattctttgctgatcaccttatctcaagtcattattttgatgtaacaaatttttgttttattaataggttcagaaacagcatatttagaaaacagatctaattctagacctttagaaagcaaaagatacggatcaaaaaagaaaagacatgaaaaacatactattcctttggtagtccagaaagaaacatgtaagccttttttctcttagttatttaaagataatccttaattgtgggtattttgatcaattatcaggattatacagttgattttcattttaataatcagtattagttaggtttatgtgtgcttatgcctttctgtattcagcttctaatcactgagtagtccactttgcttgctatcattttctcaagaagaaaaatagaaaaagagactgtcagggttttgtaggagaaaaagttcaaactcagaatgacatttgggaggtatatagagtgatcttagtttcccctgccacttgttttcatagataatcataaattggttgtatttcaagtgtatacttctagtagttgctttaaaattattatatttatatatatatatatcctaagttggtcaagctgaacttgtcaagctacacagttaggatacatggtacataggaaggtaaaatcggatgaataaggaaaggctgctgctgattggtggtgagtatagccaagggtactttacaccctcacggctaacttttcctagtttagaacaagaaagttttgattatgttgtcccttggaggcctagaaaacaagatagcccaaaatgaagatgaaaaagtccacagtgggaattcagatggactagaattagactagccagttctatagttcaggtgggccagaaatgtcagcactgtagtacgtgcttagattcagcttgggcaaggaatgaagtttagaaagtcatataaagcagtagccctataaagagatcaggatttaagcaaggaggctgagaaagtgtcagtagagcattcatgggactagaggttgatgtttcagatagtcccaaggtagagaactaaggcaagggaaacctaactcatcttggaggccagtaatgatagctttatattatcttgacctgtgctattcaagatggtagccactggccacatgtggctattcagcacttgaaatgtgactagtacaaccaaggaattgaattttaatgttatttaatttaatttaatttaaaattaaattagaaaactgataattgatccagttattataaaacttttaagtatgtttggaataacttgggcatgtgaacctaccttttcaagtgtaaattttattaaatctaaatatagaccaagtatttctgatgagaatttagcatctagattgtgctttgtgtaaaatatatgctagatttagaagatttaatacaaaatttcagttatttatattatacactgaaatgttaatattttggatatattgatttaaatattatgaaaagtaattttacctattttatatggttactggaaatttcaagttacatatatggtttgtattatatttctattggacagcattggtctaagctcaatacactacagccagttttataagtaatgtttagttattttattgtgtaaataagattttattagaatgcagccaagctaatttattaatgtgtttttattagctgtttttgtgctgcagtgtcagagttgagtagttttgacagagatcatctggcctgctaaacctaaaatatttatttgacctttgaagaaagagtgctaaaccctggccttaactctttaaagcagaggcctttttattggggcccaactgagaaagaaaggagcggtagcacctgttcctccagtctcctactttttgtctgtaggcaggttatttcttatccagggcacctttcctcaaggaactattatttgcaatatatgtgactggcagtgggtgtcatggtatcaacttactggatcctgacttaactgcctctgtcggtcagagttccaacaagaaacagatggcaacactcaaattgaggtaattttaggagggtttatttacaaagggactcataaaggtatgaatagggtataggaaaaccacaggttttgcctactaggtcatgcgagcctagtgctagcagcagagcagcagagctgttatcatctctaggccataagggattaggagagagagaggttactggatctagaaagagatactgtttatagaatacgctaccttgagaagagcagtgagcttcattgaaatgacgaaggcagcccaaggtggccttatagaaagggagcaggaataagtgtatatcctgacttcatgcttcttcctttccttgatatgccaagactcccattggattgaacccaactgaagccctactgatgtatatcaggtctgggatttgactcttacaagctagtaagttagtcttactgtgtcatggatgctagcagaagacaagactgctgggtcagagacaaaggactttattactcacagcacaggaagcagtatgtgcatcagcatattgtgttggttctcattcaccctagttcccattggggtgatatggtggacccatatggatgctgcacatgccttaggtttaggttgcagctgaggaacactgagcttggggaatccgtcactttggtagtaagcagtaatcaagcctgtgcttgtcccagagggaaacattacctcatccttcaaggttgctcactgcagacacaaccctgagaagcggcccaggtaaggagtttaggtcaaagccttgcttttttggtatatacagcaagacatattgaaggactgtctttttgcagcccatatggatcagcattccagggagaccagggtgaagaccagtagaggtgggtttggattggcagatggaagattctggcattctgggtccatagcgttaaattcttatttggattacagccgaatcagcagttctggcctgtgatcagggtgcaatattcttattgttctttctcccatattttcttaatcagaaggaaggacctacttccacaggacaatcttctttagggttgcaatattagaaattagtttctagttgtgtgtgtgtgtggttggcagctgttaaccaataatacaagattttgctttgttaccacaatgctcaaaaatacacaaaatccaagctcataacttgttctctttaccgtctccaagtgaagtaatcataaagaactttaagcgatctattacagcatgttaactagtatccatgtattattttacttttaacacacattatcttgctattttgtgttaactgtcttctggggagtggcctccttatgtactttctatctgggatgatatgatcattgaatgcctacctgatcactgaatgcctatggagtcagcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagcggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaactcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctcctaatcccagaa

SEQ ID NO: 3779 - DNA, 772 bp, Homo sapiens
ggaagctctgagtcactgaatagcaaagaaaaatatgaaagcaagaggaattgctttcacatctagaaaatgttgcaagataatctgaaatcttctggtgctggtgaatgcatgaagaggttcacagtatcttttaaagtacttctgaaaagataaggagtttaaaaggtgggtgtgtacactggcactgagctgcagtaggatttttccttggatagtctggtctggagctgggacagcagctgctgctgtggaaaggccagctggcaagatgatggaagaaatctccattatggtagcctatgacgcccatgttttcagccagctgcacgatgaagacttcctcactagtctggtggccatcagcaagcccaggtctatggtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcaca

SEQ ID NO: 3780 - DNA, 880 bp, Homo sapiens
gagattttgggaatccactgagaaaattcaagttggtgttcttgggggagcagagcgtgccctgggttccctgactgctctggccttccatgggtgttctgcgggactgctggcagcccttccggactcctccctctctgctacctgctcaggttggatgtggcatatgaccagaaactggccattggtcgggaagacgtctctgattacgaggttcatgtacgacagcttcgacaacacataccaggcaaccattgggattgacttcttgtcaaaaaccatgtacttggaggaccgcacggtgcgactgcagctctgggacacagctggtcaggagaggttccgcagcctgatccccagctacatccgggactccacggtggctgtggtggtgtacgacatcacaaatctcaactccttccaacagacctctaagtggatcgacgacgtcaggacagagaggggcagtgatgttatcatcatgctggtgggcaacaagacggacctggctgataagaggcagataaccatcgaggagggggagcagcgcgccaaagaactgagcgtcatgttcattgagaccagtgcgaagactggctacaacgtgaagcagctttttcgacgtgtggcgtcggctctacccggaatggagaatgtccaggagaaaagcaaagaagggatgatcgacatcaagctggacaaaccccaggagcccccggccagcgagggcggctgctcctgctaatgcagagccgacctgtggcttcccatgacactccttgcttgttgtgttgcttcctattggctagcttcctaaggggggagggaaccgagttatcaagatgggaggatttttcttttctctctgtctttaggagta

SEQ ID NO: 3781 - DNA, 2053 bp, Homo sapiens
acaatacttaagtcctggcaagtcataagtggggaaaatgtctctcccaagattccaaagagtaaactttgggccatatgataattacattccagtcagtgaattaagcaaaaaatcatggaatcagcaacactttgccctgttatttcccaaaccacaacggccaggaaccaaaaggagatcaaaaccttctcaaatacgggacaacacggtttctataattgatgaagaacaattaagaggagatcgtagacaaccattatggatgtaccgttctttaatgagaatttctgagagaccatctgtttatttagctgccaggaggcagcctctcaaaccaactcgtactgtcgaggtggattctaaagcagcagaaattggtaagaaaggtgaagacaagacaacacagaaggacacaacagattcggaatcagaattaaaacaaggaaaaaaagattcaaagaaaggcaaggatatagagaaaggaaaagaagaaaagctagatgcaaagaaagatagcaaaaaaggtaaaaaggatgcagagaagggcaaagactcagcaacagaatctgaagatgaaaaaggaggtgcaaagaaagataacaaaaaagataaaaaggattcaaacaaaggcaaagactcggcaacagaatctgaaggtgaaaaaggaggtacagagaaagatagcaaaaaaggtaaaaaggattcaaagaagggcaaggattcagccatagaattacaagctgtaaaagcagatgaaaagaaggatgaggatggaaaaaaagatgcaaacaaaggtgatgaatcgaaggatgccaagaaagatgcaaaggagattaaaaaaggtaagaaagataagaagaagcccagtagtacagacagtgactcaaaggatgatgtcaagaaagagtctaagaaggacgccacgaaagatgccaagaaagttgccaagaaagatactgagaaagaatctgctgattcaaagaaggatgcaaagaaaaatgctaagaaggatgcaaagaaggatgcaaagaagaatgcaaagaaggatgaaaagaaggatgcaaagaagaagggcaagtaggccttggataagaatttgaaccgaaagaataattcaaaagcatatttgatgaaacaatagtggtagtctgcagctgaatttgtgagaaaacaagaggcctcaaagaattaaataatttttaaaaggtggtaaagaaggatacaaaggagaactcagcagagatttataaaaatatataagaaagatgttaagaaaaattaaggggggatccattgaaagacttgaagaatacatatacttatattcggggatatgaaggattcaatgaatgatctctagaaagatttaaagaagaatattcagataaggatgttgaagataatgacactaaatctatggacacacacacacacacacacacacacacacacacacacacacacacacacacacagtttaatgaaggcttaaagaatccaaggagacagatgttgtatctatagatttaaaataatctcaagctgcatccacagatacaaaaaaatataggagccatgaaatgaagttaaacaccttgtagaaagcctactttcaagtaaatatagcattcctttggcaaaaagaaaaaaaaagtaaaagaaaagaaaaaaaatgtattaccacccgatgagcctacatctttctttctgaagtttaaacaaccacagtcatgtttatggttgttggatgtgccacttccaatccaaaagaagcacacttgatctactacagaatttaagaaggcagttgttctattcataattgctcacaatcagcctctcctcctactactgttcctactctctataccctttgtgtctgctcagactaccgtgaggatggattggacattacaccacactggaaaagtgaaacatctcattcagttggtgatcttcctgtcatgaaagttgcttgacagctctaattacgaattgaacacattaaacacctggtgaaattatcaattaaaaacatctagtcaccata

SEQ ID NO: 3782 - DNA, 4279 bp, Homo sapiens
gacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgacctatttaagaaaaataccacgttttaatgcagattctggctattccatccattctgattcagaaagtcaggctgaaactgtacacgggcttgatggttgtgcttctttgctgagggacattttgagaaatgaagattcaggttcagaaacagcatatttagaaaacagatctaattctagacctttagaaagcaaaagatacggatcaaaaaagaaaagacatgaaaaacatactattcctttggtagtccagaaagaaacatcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagcggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaactcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctcctaatcccagaacctcctcgtgttttttgtttttttggtggttttttttttttttttaggtgttagtgctacagcgtttgaaggagccagctgtagtctctttgatatgttcagattttccagatagagatttaagtctaaaaatttattaagtgaattctaaactatttcacacaagagtccattagcatctttaattttatttagtattcatgaattaatttattggcatcttatttggaggtaataggccacaactctttaacaaataagttc

SEQ ID NO: 3783 - DNA, 2221 bp, Homo sapiens
aatatagatccggcaagagcttagctgtgatcactcctagctgctcagcaaaccactgaggttcctgggaaaaaaaaaaaaatatctcaaggtaaaataatatttagaaaaaataatgtcagagcacagcagaaattcagatcaagaagaacttctcgatgaggagattaatgaagatgaaatcttggccaacttgtctgctgaagaactgaaagaactgcagtcggaaatggaagtcatggcccctgaccccagccttcccgtgggaatgattcagaaagatcaaactgacaagccaccgacaggaaacttcaatcataaatctcttgttgattatatgtattgggaaaaggcatccaggcgcatgctggaagaggaacgagttcctgtcacctttgtgaaatccgaggaaaagactcaagaagagcatgaagaaatagaaaaacgtaataaaaatatggcccagtatttaaaagaaaagctcaataatgaaatagttgcaaataaaagagaatcaaagggcagcagcaatatccaagaaacagatgaagaagatgaagaagaagaagatgatgatgatgacgacgaaggagaagatgatggtgaagagagtgaagaaacgaacagagaagaggaaggcaaagcaaaggaacaaattagaaattgtgagaacaactgccagcaggtaactgacaaagcattcaaagaacagagagacagaccagaggcccaagaacaaagtgagaaaaaaatatcgaaattagatcctaagaagttagctctagacaccagctttttgaaggtaagtacaaggccttcaggaaaccagacagacctggatgggagcttgaggagagttaggaaaaatgatcctgacatgaaggaactcaacctgaacaacattgaaaacatccccaaagaaatgttactggactttgtcaatgcaatgaagaaaaacaagcacatcaaaacattcagtttagccaatgtgggtgcagatgagaatgtagcatttgccttggctaacatgttgcgtgaaaatagaagcatcaccactctcaacatcgagtccaatttcatcacaggtaaagggattgtggccatcatgaggtgtctccagtttaatgagacgctaactgagcttcggtttcacaatcagaggcacatgttgggtcaccatgctgaaatggaaatagccaggcttttgaaggcaaacaacactctcctgaagatgggctaccattttgagcttccgggtcccagaatggtggtcactaatctgctcaccaggaatcaggataaacaaaggcagaaacgacaggaagagcaaaaacagcagcaactcaaggaacagaagaagctgatagccatgttagagaatgggttggggctgccccctgggatgtgggagctgttgggaggacccaagccagattccagaatgcaggaattcttccagccaccgccacctcggcctcccaacccccaaaatgtcccctttagtcaacgcagtgaaatgatgaaaaagccatcgcaggccccgaagtacaggacagaccctgactccttccgggtggtgaagctgaagagaatccagcgcaaatctcggatgccggaagccagagaaccacccgagaaaaccaacctcaaagatgtcatcaaaacgctcaagccagtgccgagaaacaggccacccccattggtggaaatcactcccagagatcagctgctaaacgacattcgtcacagcagtgtcgcctatcttaaacctgtgcaactgccaaaagaactggcgtaagaggcaacagagccatctagaagaacaagaaatggaaatagtgactcttggattacagcatggagactatgtcagcagcaatactttaggatccacgtggcagaactggaaacaatgctaccatctgataagggtatttgtaaaaggcagaatgtttgggccatgaagaagtaggggctgaagaggaaggtggaaggagataaaatataatatttagaggcaatattttctacttgcaatcaatttgagtgactcaggtgaaatttagagtcatatttcccgaagcagaagttaaagaaaattttttaaacatttgctttattattgttttcttctggtaaataataaatataacagaagtgttaactattgtattcccatttttttctccttccatctcttctgcggtaattcatcacatag

SEQ ID NO: 3784 - DNA, 522 bp, Homo sapiens
agccgggaacagctctgaccacagtaagtcatcccaaaacctcacattcagatgaaaccatttaagaatttcatctgcactgaggaacaatttagcgtgatactggagggaaagagtttccctgtgagatccaggaggtccctttagctcgtctcctgacgtcaccacagtcatacccaagaggaaggaaacgtcagagacaatgatttggagaacattctacacaaaaaccaagtggttccggggagaagcctttccaggacccatgtgtaggcacaactgttttccctgatcaggatacttgcggcactcaacagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggtaacc

SEQ ID NO: 3785 - DNA, 558 bp, Homo sapiens
agcctccgcggccgctgtcagggaagcgcaggcggccaatggaacccgggagcggtcgctgctgctgaggcggcagtgtcggcagtccaaccgcgactgcccgcaccccctccgcgggggtcccccagaggactcaccagcgctctaagtcagatgccactgccagcataagtctcagcagcaacctgaaacgaacagccagcaaccctaaagtggagaatgaggatgagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggt

SEQ ID NO: 3786 - DNA, 8478 bp, Homo sapiens
ggtgtcatggctgcttgaagtcccgggagtcggtgaggcggctgcaggtccctccctgcggagccgctggtccggctggcggagatgtgaccgcgggcccggccggcctgcctcaggcgtcgcgtcagctcccgtgtccgtgcccttaacccacaccgatggcgggatccggctgcgcctggggcgcggagccgccgcgttttctggaggccttcgggcggctgtggcaggtacagagccgtctgggtagcggctcctccgcctcggtgtatcgggttcgctgctgcggcaaccctggctcgccccccggcgccctcaagcagttcttgccgccaggaaccaccggggctgcggcctctgccgccgagtatggtttccgcaaagagagggcggcgctggaacagttgcagggtcacagaaacatcgtgactttgtatggagtgtttacaatccacttttctccaaatgtgccatcacgctgtctgttgcttgaactcctggatgtcagtgtttcggaattgctcttatattccagtcaccagggttgttccatgtggatgatacagcattgtgcccgagatgttttggaggcccttgcttttcttcatcatgagggctatgtccatgcggacctcaaaccacgtaacatattgtggagtgcagagaatgaatgttttaaactcattgactttggacttagcttcaaagaaggcaatcaggatgtaaagtatattcagacagacgggtatcgggctccagaagcagaattgcaaaattgcttggcccaggctggcctgcagagtgatacagaatgtacctcagctgttgatctgtggagcctaggaatcattttactggaaatgttctcaggaatgaaactgaaacatacagtcagatctcaggaatggaaggcaaacagttctgctattattgatcacatatttgccagtaaagcagtggtgaatgccgcaattccagcctatcacctaagagaccttatcaaaagcatgcttcatgatgatccaagcagaagaattcctgctgaaatggcattgtgcagcccattctttagcattccttttgcccctcatattgaagatctggtcatgcttcccactccagtgctaagactgctgaatgtgctggatgatgattatcttgagaatgaagaggaatatgaagatgttgtagaagatgtaaaagaggagtgtcaaaaatatggaccagtggtatctctacttgttccaaaggaaaatcctggcagaggacaagtctttgttgagtatgcaaatgctggtgattccaaagctgcgcagaaattactgactggaaggatgtttgatgggaagtttgttgtggctacattctacccgctgagtgcctacaagaggggatatctgtatcaaaccttgctttaatcagtaacctaaggactgtttcctttttctcctcttccatttcttgggttattccacatatgaatgcaggactacccccttaccattttaagaaggtactttatacatttatttaatcctactaatgtgcagccattgcccaagcagtgactgcgttgcatacatttggcactgagtaggacaagacctctcagctatacattgaggggttttagagcatccatgtgggcaacccttttttgtgcgggagagcaggtgttgctcttcagtatgtagcctaaaaaaatcttaattatttcatggatcatgaagcaaggatgaataatatcatgtcttggtaaatactaacaaatttgttaggtttggtgacatcatttacagattatttctttatgttgtccagtggttcttccttattgttgatatccataagctggcactggatgctctcagtaatgttaagtaattgtcaagcagcagttacctactgtgttcttaacactgagttgtgaattttttcttaaagcagtactgtagtactgaatattcctttaaaggaactgcagtgagcctatctaagtttttttaaattaaggcttttaaaatagaaagctgatgcttgatcttgcacaatttttatgtctagtatgtatgcttgagtgaatgtgcgagtatgaatgattagagaaaatttgagtcagtgtactttatagtgtgaatcctgtgagctaatacagtctatacttatttcttccctacctgtttcacatccgtaagatttaagatatacattttttgagaggtagtctgtctgatacaatgtaaatgacaaaacataattcctgagaggcccagaacaaactggagtctagcctggagttaaattgagacttctaaaatgattggaacaaagactaagttgtgccagatgtaaatcaacccctcttttagtttactttagactttgtattagctcatcttttttgtagtaaatctatagttttaaggtttctcaagatgtggctctacctactatgatgaaaattgaagtgggtcaaaagaattagatgtacagtgaagggaaaagaaaaaaaatgggcgaagagagggtggaaaataaaaggattcttttttcttcctttctgtttctcgtatccctgctccctttttcctccccttccctcattctttgcctctatccttagctgaagacaaactagaggagcagcatcccaggtagtttggcttttgactgcaaggtagttaagaaaggtgtagatataatgaggtagaagtagaaaggaagaaaaactcaaagaattcttaaaaggattcatagcaacataatgtgtccctgagtagaggatgctgctatgcgtgagttcatggacacaagttgattacatggtttttagaattataattatggattcttcttatttcatggtaggttgtctttaaagatataaaaattaggatgcctttatgaagcactgattataccaaaaaaaaaagacaagttatatacaggttattaatttttttatttatttattttttcctaaggaaaaagtcttctatctttccctgctggaagcctcctcatatttccttatgtttgccatgcaggttgctgagagtccagttagaatttgcattttacagaatgaaatactttaccccattcaaacaattattgtttgacattttagttatttataattgtcaaattcaggactctcctttaatgtttattatgaaaccaaatttggcataaggaggctgatttatgaattaccaaagggtcttgtggcatgttccccaatacatgcccttagaaggaagaactattattttttattttggccctttcaggagttgattataaattggtttgttttcaagtcagaattcaagtgggcagaacccgtattgtgaagacctaaactttcctaaatgttcatatgggtagcagattttgtggtgattagaaacatcaggtccttaaatacgatgaacatgggatacaaaggaattctttataagggcaagtatcctaagttagcacatttacttttctctcccctccgcccccaaaagaaaaatccttacaaataaactgcaggtaggcttctaagcctagtcctgcagtatgctgctaacatcttgatgccaatcttcacagcattctttgattgtcatcttattgctgatacattcatacatatatttagtgcttgacactgtagaattttgttacagaagatggttactagattttaagggagctgagggaataattgatgagccttgaattaaccatgcatttaattagattttttgttgttgttgttgttgttttgagatgatgtcttgctctgttgcccaggctggagtgcagtggctcaatctcggctcactgcaacctctgcctcgcaggtttgagcgattctcctgtctcagcctccccagtagctgggtttacaggcgcttgccaccacacctggctagatgttttatattaaagccagagaattgaaaaagaaatgcctcctgtgattgaaattattttatagctcttagcccgttctaccaaagatcacattagcagattacccctccctcctgtgatattatctttcttaaacctgaaccaaatatcaaaagatacaagtttcatgattaggatgaaatatatacatagggattttggtttattgaagttattgaaagacctagaaattttctttttgagagaaagggtaaagaggtgagggttcatgtcacttaacccctacccttttgggcaaattttgtctcaggtagtgtttcattccctaaattaatacctgtgcttccttgcctctcaccttcccagttacttctttggggtattactgtggcacattgtacacccagaaaaggcacatacagtgattattttgtgggaaatacttgattcttttgaaatatatttggagggggtagctagctagccactgtcaaaactaatgctgtatttacaggacaaaaacaagtagagttggacacctcagtaagagacagcattaactaaaagtactgactgccttttaaaggaatttttaaaactattctcttgcaataagagatccgcatttattaccactggatgtcttccttttttgtggccaccaatatagcagctctctttagagggattccctttctgctatgccttgagccaaactggctgcttttagaacaaaaaccataagtatggttttactcgaacttctctttgtttttattgagagaaatattgccttctttttggtactccagctgctaaagagtgctgagatatgttaaattattttttaaaagaaaatctccaaatacttatttaacttgtcttctagattcatgttgcttatattttaactattgagcaagtttattataaggaatgctgccatatagagaaagctgaagagaaaccatgggcagaaggcttttttctgtcttattacactggaccttcactctggtaagggcatcagttacttttctggaataaaaggcggagttagagcacttatcagatgctgtttcatggcttgttttagttaatttatcatgcagataactaacatttgggtatctttttgttttaggtcttattttctgactgttaggcctatcttacacataagttctactatcagtatacttggcagcatgacttttttttttttttacagttaatttaatgaaaatcagcaccattgtaaatgatagtaattgtaacaacatagttactgggtgaaggagtaggggagacactcagtaaccatctatttacctagacacttatgcaggggtacatgctaggtggctttattcagattcgggtacattggaatcacatcatgactttgagtctgatggctgtgtagataaagatttaagcaagtgccttgtgtttgctggaaaatattaaaactcatttgggtgaaagcttcccagatgatgataattaatagcacttctgcctttttcctggagtaacttttagattgagtcacatatgatagtataaaagtccaaaattttctgggtttacctttgttttatttttcatatatatattcactgtctgcctggaaatagccttggtttaccttatttttttgtatatgtaaaactattcatatttgattttattccaatattatatatgatggaaaagccagaattgtctggcagaatttaattcttccttggatctctagttctgtttttaatatcaggttccttcatcaaattttactactgtagctctgtgatataatttcatttcttgtcaattatggtcacatatagacaagtacttggtcacaattagctcaaaagaatccccatttcttaaggtgctcagtcaatcacctttattttgagatggtagtttttcaagttagtattacttactagctttcttgatgaatataaaaatgttgtctccatcatacagagctgagcctcttgtggtatattaagataagtcccattcttaatcacagaagaacatggatattttagtttttggagtacccagaattgtaaagattttgtttcattttgttttaggatagcttctctgcctaatactataggatatgtcatgttcgttattgtagccacctccctcagatgtttttcactatttttaaattatataatgaccagtagattcacagtagcatgtacttgacaagtgccatggatatttaagaagaaggtaaataattttaatattttttgctgtaattttataggagcagtggactgtaagagaaatatctataaatcagagagtatttaggaaactttgtattttataggtggtcattaaagtgatcttcaggatataagatagtttacacaaactttattctcctgataggaaatttttattcattttcctaccactcagcacttttgttctgccttgtactgcttatgaggattaatgttttaaatttgctttatttgtgcttttcagagagttgtcataattgtggcagttgtgtttgtggcactgtaaatgctgaaattcatgggaaacttaccaaatgactgcttgagtgttatttcccattaaattgggtagctgtcacaataaccagaagaaatcttgtggcccttttgaagaaagccatgtatgttttgttacctaggttcatagtattttaatttaaaggcaaagagaagcattctacttatttgtcttataaaccattaatcgttttttgtgcagaagagagcttattttgttatactgctttgtataatggaaataagtcacattctgggggaaaaaaactggaattgtttgtattttgtttttttggggggggatctttatgtgaaaaatcagagctacttgttaccataagcccttactatcaacaagataattatttgtaatcacttttttatcccaggttggaattgctttccccttctaagttatcttcccttaataatatttatgataccaggacagtgagggtataagagcaaatgtagtgaggtattcaaaaatcctgcatatatggactcaaaagttctttagttatttgaattatatatagctatattattttattagcttgggttgtcagaagattgccaattttaagagtaaagaggagagagataagtaataaaaatagaggaggggaagaaaatggctcccttactggtcttagtaatcttctatatagttaatgagctaaaaaatgatacttaaagttccaggtttggtaccgctagcatagaaacattgcctttcctacacattcctcatcattgtttcctcagaaaattattttaagagtttgtgaaaccagattaaatatctatattcagtttggcctaatttttaaaaataaatatttatactccagcttttgtgtatttggtgtacatcaccacttatgcaaatcaaggatcagaaaactggaggttagccatctccattatttccttttgcacattgggtacagtgggtggcattagtatgcactagctgcaaagtcacagcaccttatggaaataagtatgtttattataataaaaaaaagttaagctgcatctctgtagattatttactttgcagactgtaaagctgccctatcttttccagcagaatttactcttccattcttaattcttttttgaaatatcttaaataatttaacattcctttataacttcttaacagtgtcaaaactggggtagaagggattttattttttcccaaaagggttccatctttgctatctgttgatcagccttagaaaatctaagtatgatcaataaattttaatggttgatggcatcctgtgtcagctggagtagttggttgtgaatattaaaacctagtactattttccctcagtaacatgtaattgctacattttttataagaaggtatggttagaaaaaaatgtgaaagatcacttaaaccaaagccagttacaaggagtaatctctcctgttggtttaccttcacctcagaactacaagaatattacaatacatagtgaatagttgtctgtaacatttctaccagttgtttcagtagcatattggtcttggcatttcttggcactgtggttctgctgtattatttgtgatgtcttattgtttgtgagcttttgttttttttttaaagaaaaaacaaaaactaagtgggactatgtatgtagatgtgtgtcagtaccaaaaagttattttctcaaatccctaaatttctgatttccattcaagtcttttaaactctttcctgctgaatagcaaagaacttttattttccactttcctatattcctaaaaagtgtgaacaatgcgtttcagttgactgtattgcatacttttttgctgaagactttttctgtaaacacaattgccttgttcagttttgttgtaaactgacttaccataagatgcactgttgataatgctttctgatgtgtgtttgataagagtgataaaataaaagcttaaaaataaa

SEQ ID NO: 3787 - DNA, 1553 bp, Homo sapiens
cccggagccgaaacaccggtaggagcggggaggtgggtactacacaaccgtctccagccttggtctgagtggactgtcctgcaggtcttgttaagaaaccagtcctgccttcttgccactcgtgtctttcgatggctcccttcccgaagtcccgctgcctctaagcggagtgttaagcggggctctcggaagccggtggaccgagatttccccgggtggggcgggcgcggtgtagcggcccgcgggctgacttgctcccggctgtcccccggccccagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaa

SEQ ID NO: 3788 - DNA, 6821 bp, Homo sapiens
acacacacacacacacacacacacacacacacacacacacacacacactctcacacattctcacatgctagacccttctaagcagcttgtccgtttttacacatgtatctgaactctcctgcatcactcttggccattttctcgcattcgattgcttttgccgttttttatttagatcagtacttgatttcattttcattttccagtctactttggggttctcgcagtggataatttagccaaaatgtttttcttgtggagacattagctgacaattcccaccacagactggcttgtacgtcctcccagggagacctaaacctggctcccctcccaccgcagttcttaatattgtggataagagatccatctttctcattctggatacctacttagtgctcatggaagaaggggtgccctgcccagccccagctgctaagctcacacctcctgtcaaaaagtcccaggacatgcacgacgagaggagcaagctggtgaatgagtatgcgtgtcgagtgctggaacttctggggatggggcatcgtctgtttgtgcctcggcttctggcgacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccagggaagtgttaatcctgtccaaaggaaagaaccaatcagcgatcattggtttactttcattttctgttcggtacatctggaaatgaagtgccaggaatagacgggctgttcagattatacgctaggtaaaaggaactgaaattttaataagtgtaggtcaggatcatttgggctgtggtattctaacagatccttttaagaatgccacataggacttgtgagttcctaagtacaccaaagtatggacacagatgtgacttctggcaattataaagttaaaggtggatattgcaccttacagacttagggagcctttaccagagacgcctaaaaagccccaggttcagccattgtgctgaatagagtggaatatagaaccagggacagagtatttcatttaacgttgatatatacttgctaaggaaacactaacaatactgtaactttgttaaaggacatagtattgaaatgggaaatagaggtcaggctcacatcatcttagtttaatgctgggcaactttttctgatttctgtagttccctgaaaatgtgtccttcgtacccataaagagatacaaatgcatttgtaacatttttgattgaatataaaacctttacagaaatacttatctcatggaaaggtaaagctattgtttaaaaattagtggaaatattttttcaattatatttaacatgcctataaaaatagtccttgcaggaaattatttgataagagcaaaactatttttattttataaactattttggaggcctctgatcctttcaaaccaaccaaactactattagatatgtacaataacatttgttgatattaatcattggcctcattgttgaacatattatttgcaaagaatcttaaactctgtagtgccagaatgattctcatctgtgccatattttgcaattaaaagtaacacacccttagaagaatcaaataagagccatctacatcccaggaggatgcaccaagttgctcacagtggatcttttcctctaaaatgatcttttatgttctaaaaagtgaaatcccctttatctgtgtttatattctctacagcccataaaactgatgtgattgttatgttatactcatcagataatacttttcttacataaatctttcattgttgttctgacatctttcattacaaaatttattttcttaacaaaaaggaacataacccagcattccaagtgtctgtgttggctttaacattctctacatggtggtctagataagctaatttttttttttttttttttgtaaaatgtaatagctagaaaatgttatcttggcgcttgtttttgtaaatcatttagtataggctgttagctttactggtactttacgctttgattccaagaagccttgtgcagttgccttatcaaatggccagctaaattaaagatgctcttttgtgttgtgaatttcatagttctgtacagagcttgtttcaatttacaaaaataagtacattccacagaatgcctaaagtgtgtaattttctttaaataatagtaggtgagggagaaacataatggctctaggtcaatcccttatctaaagaccttgttcaacttcatagtccctttccttttaaagaggagaagagaaaaatcccccctggccaggcatggtggctcacatctgtaatcccagcactttgggaggctgaggtgggtggatcacctaaggtcaggagtttgagaccagcctggccaacatggtgaaaccctatctctactgcaaaatacaaaaattagccgggcttggtggcgggtgcctgtaatcccagctactcgggaggttgaggcaggagaatcacttgaacccaggaggcagaggttgcagtgggccaagattacggcattacattccatccagcctgggcgacaagagcaaaattccgtctcgaaaaatcaccaggtacatacctctcaagtttgataagtccatcttttgagttttcttttagctctttcaaaagattacgagggcaatacatattttttttttttttattctccagccccatatcatacttgggtatgcctgttggtaccataagcctaaactctccttcactgcaatgcctttgagtcagtagcaatagtaaagactagaaacaaagaaaattcagaatttggtatgtgatatgattgttcatacaatatgttataatagcaatattccaaacaatatgtccttcactgtctattgttggaaaactcatgcatcccagcatgaagtaactcctagttttaattttagttattttgagatatatttgagaattgcatctcttctcttgaatttcacttagaagagattaaccagccaaatatccaggaaagtttcaaaacattctagtgtttttcatcctttgctaggatgcactctgtacaaaacattcctctgaaaatctaatatttgcagtatctaagaattgatcatttctattttcattaaattctgtggaaaaaattaaatgaatgaaattcaacttcataattcagttcatcagcttttgtatcttgagaatctaaacacgtctttaaatctgaaagaaaccaagctggattttgcagtgcatatgtttgctagcttcccacatcctgaaccatgtcaaaatttggttttatttagttacatataatttaatgcaaagaaattctgttacttaatgttctgtttatttatgagtgcctatcaggaacactaataggaatgccattcaaccagtgtcttctgcccctctcccagctgttaaattagtacttcttcattggctttctgaaatgtcctgagtaaagtagaaaagcaacctttgtatggatgtggggatatttaatagtatgtatcttgtttcatttttttcctatgatgtattaatatttatttttctccaacccctgctccattttcttaaaatattttccagttaataactagttgctttatttcctagctgaagtgagaaaaccaacggaaaacaatacagatttgggcagaggagatagagttacatctttaaaggagtgagccagtcacccaggagaatcacatgtgtaactgatgtaggggtttaagtcttcatactttcactaaaatctgtctactaactctcccaccaacctttgcatcaaacacttaggtacctgcctgattaggggggcccctttaagggaaaaaacttttaaaaaattaaatgccttggttttgttttatcttctgggaaagaacacttttacttgattagcaagatgattatattatataacttgcccttaaaaacactccaaaatactgactccttttctccaattacaaatgagtgtgaagaaattctgttgtatgatttgaacactattaggtttgtatgtgtgtttaattggaagaattttatatagagtatctctgctgcttttgtttacctgggtaccacacaaccaaatacacattgagatttcaagaaatgatgatgaaagccagaaggccagaccacagctctgcagcctgtttcctacaaccagatataaaactctttctcgtcgccatgctgatagtcacactgaactagaactgtcccaacacattcttcctctctcataatggcttccatttaatacaggcaaagccctttaccttagcaaattctttatctttcaaaagtgaccaaaatgaggacttcaaccttggctgcacctcaataggagatgctgatcttgagttgtaatgagaaaagtgggcatataggagattttagtgactgcagtcagctgtctggcattcctttctcagtttgcatctaaaagactacatatgtcaagcttatctccacctgaatttgctgcctgctataaaaacatttcattaatatatcccattcttcctacctccatctctggtttgtcattagtggtattctgaaaagcttaagaaaaaagaatcattgagtagaaagtgaacattttaagttattttcctttttcattggcaattagttaacatgtaaaatcttttccattaaactgtataacttttaataactatatattatatatgggataaaatatatggactgaattgtgagaatataaatgcatcgaaagactctggtgtcatgaaagcacaagaataaggctggagatggtcccagatccaagatgtcccaaaagccttttgtatcagtttctctatttttggtattttgcataatgcatggatccttagttcaaatgagggacaaagtttctcagtcagccccacttcctttctttctaactcctacctttcccttgcagaggaggtagtagagattctggaattgtctatttttatgaattccattattttgtccatggcatctctaatgaaaacaggttctagaataaaggagttgattagtctgaacagtactaattaactacaaaataaacgttagtgatcagcctcttcctctataaacaatgaccaattagacgtttccgtaattccatgtattatgtatagtacactctataaatgtaaatgtaatgcttgtctaaaaagtgcaatttattgtacattgtcccaacaaatgtttacttttataatcgttatgaacttgaattggattagtatcttgtttttatgtgtgaatgaagccttgtgaaataaacaaatgcaactgagaaggtaacaaggtgactgtttttgtgagccagtgatgttttcaatgctttgtgttgcccctttggccccattaagcagtaataaacatttgttctgaagtcca

SEQ ID NO: 3789 - DNA, 6476 bp, Homo sapiens
gacaaatactgcatgattttacttacataaagtacctaaatagttaaaactcatagaaacagaatgtgagcatggattgggcgtgaaccagagggatttttgttttttgggtttttttttgtaaagaacagtattgggataattggcaacatgtgaataaggtctgaatattagattgtaattctgtatcaatgttaatttcctggttttgataattatactgtggttatgttagagaatggccttgtttttaggaaacatttaggagtaaaggagtattgtatctgcaaacttaactctaatggttcaggcaaaaagtactgctgtgtatatatattgagagagaatatggaaaatgtcaaggttcacagaatctgagtgaagcatatatagggcatctttgtactattatttcatagtagaaactacaaaaaaaaattgaaaggaattgttccaatatgacagttactgtttcaaggtgcttttatcatgggtagttttctttaccagattttctataatatagccttgtgtatattttttggagaaacaccatatgtaatcttacagttatgccagacatatacctcagacagtgtactttaattgtggtagttgtttttggactcgatccagggtatagtattatagtgtcatggcttggattttttattatgattccagccaagacatcgacataaatataccaaagggaaggaccctgagagtgtgatgcagagaccagtggtgtgatgttatacaaggtcttatttcctacattgttggttctcactgctggcttcatgaccctccatcataatccaagttatctcaagacgtataactcttaccaacccagtttttaaaaaatgtattctcagtgacattcttagaaggatggagcacatattcaagcatataatagaatgccgtataactttagaaagtttggtagttacagctcaaagctatctggagatgaaattaaatatgtgaagagaaattataaataaaactgccaacagtgactacatctggagggtggaactagggggggaatcagggactttctcatgtctatttaaaattattttgaataaagattatatttatctgatataaaattattaagatataaaatagtataccatggaaagtgtcccttctcgctctgtcccccagatactctgtttccctccccagaggcaaccatgattaactgtttctggcataactcccaagatactggatgcatgtaaaagcaaatgcttattttttcctgtttttctacacaaaaggttgtccattattgtcacttttaaaacaaaaaagtttaagaaaacaacagtggtatatgaatttaaaaagaaaaattaagacagtgagatgtagataaagagacagggtagagttctcacttcctggtctaatcaggcattctaaagaatgtacataaaaggaaccagagttaagaactctgtcctatatcatgaattaacttgcatgtttcaaagaatttgggactatagaacatattttgggattaatatagtctgaacttagtgtagtagttacttctggtttaaaatagtatctcaatttccttttcaccttaaatagacttaaggaacaaatatatgtgtagtttgcttgacgttttacataaaagaaatttaatatatgaattaaattataattgtgtatttttaggatatatcacattaattaaaacagtgaataatgtggtacatacatataatggaatatatttgacctcaaaaaggaagaaaaattttgacacatgctacaatatagatgaagcttgaagacattatgctaagtgaaataagccagtcacaaaagaacaaatattgtattatttcagttatataaagtttctagactagtcaaattcatagaaactaggatgatagttgctagggtcagggagaagaggggatggaaaggtattgtttaatggatgcagagtttcagtttgagaagatgaataaaagaaaaaaatgacattaaattttgtcaagatagcatattgaaaatataatagaaaaatatttgtttatctgctataatatattatgtcataggtgttatcttcaggaaggcacactggacctgctaaattaacaaatggaaagaaagcgtaagtacttgaagacgtttacaacttcagatttcaaggaatttttcaggtctttgggctggatgacatgtcgtctaccccagaaaattaggtaggcctctaccatcacaagctctgaggaacaatttttcatgtctacccatgttaatcattttagtatttaacagtctttctgatcttcagaatgtgtttataaattcatcttgtacatggttggacaagctttcttgtctttgctggaaagaaaatgactacttactaatatattttgggaaaaatatttgtaagaatattaataagcttgttttccaggacctatttaagaaaaataccacgttttaatgcagattctggctattccatccattctgattcagaaagtcaggtaagattgaatagatacaatacacactattttaattagttttcaaatagtagctaaaaagtaggaataaaatgcaaagtattaattgctctaaggaagtatgaagtctgttgctttaaaacatcttttctaccaataatagtttgtaaataaacaaattttaaaactacataatttatattttttcctacactaacagtcatatacaaatgtattctaaatgactttatttcttacaggctgaaactgtacacgggcttgatggttgtgcttctttgctgagggacattttgagaaatgaagattcaggttttttttttttaattctttgctgatcaccttatctcaagtcattattttgatgtaacaaatttttgttttattaataggttcagaaacagcatatttagaaaacagatctaattctagacctttagaaagcaaaagatacggatcaaaaaagaaaagacatgaaaaacatactattcctttggtagtccagaaagaaacatcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagcggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaactcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctcct

SEQ ID NO: 3790 - DNA, 2560 bp, Homo sapiens
gttggagtgggccctgtgcctctgctgtctcctactgctaacgagtgaacaaccaaggcgatgggctgtaggatgttgatacatctgaggggccagatggccaccatatcagggaaagccaatgtgttttgaaaaatatgcaaatgttcaataagaaatcaagcagaagattgagctgctgatgtcagttaactctgagaagtcgtcctcttcagaaaggccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccct

SEQ ID NO: 3791 - DNA, 821 bp, Homo sapiens
ggagccgaaacaccggtaggagcggggaggtgggtactacacaaccgtctccagccttggtctgagtggactgtcctgcaggtcttgttaagaaaccagtcctgccttcttgccactcgtgtctttcgatggctcccttcccgaagtcccgctgcctctaagcggagtgttaagcggggctctcggaagccggtggaccgagatttccccgggtggggcgggcgcggtgtagcggcccgcgggctgacttgctcccggctgtcccccggccccagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaaca

SEQ ID NO: 3792 - DNA, 4780 bp, Homo sapiens
ggcgggcgcacggccaggccatgcctggggaggctgcccgcgccgagctgctgctgcccgaggcggaccgacccgggccccgcacagatctgtcctgcgatgcggccgctgccaccaccatcctgggaggggaccggcgggagccctgtgctctgaccccagggcccagccacctggccctcacgttcctgcccagcaagccgggtgcccggccccagcccgagggagccagctgggatgcagggcctggtggggcaccctcggcctgggcggacccaggggagggcggcccaagccccatgctcctccctgagggcctgtcttcccaggctctgtccacggaggctcctctcccggccaccctggagccccggattgtgatgggagaggagacgtgccaggccctcctgtcacccagagctgcccggacagcgctcagggaccaggagggtgggcacgcaagcccagacccaccccccgagctgtgttctcagggtgatctttctgtgccttcccctcccccagaccctgattccttcttcacgcctccctccacccccaccaagaccacctatgccctgcttcctgcctgtgggccccacggggacgccagggactcagaggctgagctgcgggatgagctgctggactcgccccccgcctcaccctcgggctcctacattacggccgatggggacagctgggcctcttcaccctcctgttccctcagcctgctggctccggctgaagggctggacttcccctcaggctggggcctgtccccgcaggggtccatggtggatgaacgagagctgcacccagcagggaccccagagcccccgtcctctgagtccagcctctctgcagacagcagctcctcctggggccaggagggccacttcttcgacctggacttcctggccaatgacccaatgatccccgcagccctcctacccttccagggcagcctcatctttcaggtggaggcagtggaggtgacaccgctatccccagaggaagaagaagaggaggctgtggcggatcccgacccaggtggggacctggctggggagggtgaggaggacagcacgtctgcctccttcctgcagtcactgtctgacctgtccatcacggagggcatggacgaggcttttgccttccgggacgacacctctgcagcctcctctgattcagactcagcctcctacgcagaggcagatgatgagaggctgtacagcggggagccccatgcccaggccactttgctccaggacagtgtccagaagacagaggaggagagcggaggtggggccaaggggctgcaggctcaggatgggactgtgtcctgggccgtggaggctgctcctcagacctcagacagaggggcctatctgtcccagagacaggaattgatctcagaagtaacagaagagggccttgctttaggccaggagtccactgccactgtgacccctcacactctgcaggtagccccaggcctccaggtggaggtggctaccagagtgaccccacaggctggggaggaagaaacagactccaccgctggacaagaatctgctgccatggcaatgcctcagccctcccaggagggcatcagcgagatcttaggccaagagtctgtcactgcagaaaaacttccaactccacaggaagaaacaagcctcacattgtgtccagactctcctcagaacttgaaggaagaaggagggctggacctcccctctggcagaaagcctgtagctgcagccacgattgtccccaggcaggctaaagaggacctcaccttaccccaggactccgctatgacaccgcctctgcccctacaagacacagatctctcatcagccccaaagcctgtggctgcagccacgattgtgtcccagcaggctgaagagggcctcaccttaccccaggactccgttatgacaccgcctctgcccctacaagacacagaactctcgtcagccccaaagcctgtggctgcagccacgcttgtgtcccagcaggctgaagagggcctcaccttaccccaggactccgctatgacaccgcctctgcccctacaagacacagatctctcgtcagccccaaagcctgtggctgcagccacgcttgtgtcccagcaggctgaagagggcctcaccttaccccaggactccgctatgacaccgcctctgcccctacaagacacagatctctcgtcagccccaaagcctgtggctgcagccacgcttgtgtcccagcaggctgaagagggcctcaccttaccccaggactccgctatgacaccgcctctgcccctacaagacacagatctctcgtcagccccaaagcctgtggctgcagccacgattgtgtcccagcaggctgaagagggcctcaccttaccccaggactccgctatgacaccgcctctgcccctacaagacacagatctctcgtcagccccaaagcctgtggctgcagccacgattgtgtcccagcaggctgaagagggcctcaccttaccccaggactccgctatgacaccgcctctgcccctacaagacacagatctctcgtcagccccaaagcctgtggctgcagccacgcctgtgtcccagcaggctgaagagggcctcaccttaccccaggactccgctatgacaccgcctctgcccctacaagacacagatctctcgtcagccccaaagcctgtggctgcagccacgcctgtgtcccagcaggctgaagagggcctcaccttaccccaggactccgctatgacagcacctctgcctctgcaagacacaggccccacctcaggtccagagcctctggctgtggccacccctcaaaccttgcaggcagaagcaggctgtgccccagggacagagcctgtggccaccatggctcagcaggaagtaggtgaggccttaggccccaggccagcacctgaggagaagaatgcagccctccctacagtcccggagcctgcagccttggaccaggtccaacaggatgacccacagccagctgcagaagctgggacaccttgggccgcacaggaagatgcggattccactttgggcatggaggccctcagtctccctgagccggcctctggtgctggggaggaaatagcagaagccctttctaggcctggacgggaagcatgtctggaagcgcgagcgcacacaggtgatggggctaagcctgactcaccccaaaaggagaccctggaggttgagaaccagcaggaaggaggcctgaagccactggcacaggaacatggacccaggtcagcacttggaggtgcaagggaggtccccgatgcgcctcctgctgcctgccctgaggtcagccaggcccggctcctgagcccagccagggaggaaagaggcctgagtggcaagtccaccccggagcccacgcttccctcagctgtggccacagaggccagtctggactcctgcccagagtcttcagtaggggctgtgtccagtctggacagaggctgccctgacgcgcctgcccccacgtctgcaccaacctcccagcagccggagcctgtactgggtctgggcagtgttgagcaaccccacgaagtacccagtgtccttggcacccccttgctgcagcccccagaaaaccttgccaagggtcagcccagcacgcccgtggacaggcccctgggccctgacccttctgctcctggtacccttgctggggcagccctacccccactggagcccccagccccctgcctgtgccaggacccccaggaagactctgtggaagacgaggagcccccaggctctctgggcctcccaccgccccaggcaggagtccagcctgccgctgctgctgtctcaggaaccacacagcctctggggactgggccgcgagtcagcctctcgcctcactccccactcctcagccccaaggtggcctccatggatgccaaagacctggccttgcagatcttgccgccttgccaagtgcctcctccctctgggccccagagcccagctggccctcaagggctctcagcccccgagcagcaagaggatgaggacagcctggaggaagactcgcctcgggccctgggctcgggccagcattcggatagccacggggagtcatcagccgagctggacgagcaggacatcttggctcctcagaccgtgcagtgtccagcccaggccccagcaggcggcagtgaggagaccatcgccaaagccaagcagagtcgcagtgagaagaaggcccgaaaggcaatgtcaaagctgggcttgcggcagattcagggagtcaccaggatcaccatccagaagtccaagaacatcctctttgtcatcgccaagcctgatgtcttcaagagcccagcctcagacacttatgtggtctttggcgaggccaagattgaggacctgtcccagcaagtgcacaaagccgcagctgagaagtttaaggtgccctcagagccctcagccttggtccctgagtcagcacccaggccccgggtgaggctggagtgcaaggaagaggaagaggaggaggaggaagaggtggacgaggcggggctggaactgcgtgacattgagctggtgatggcgcaggccaatgtgtccagggccaaggccgtgcgggctctgagagacaaccacagtgacatcgtcaacgccatcatggaactgaccatgtagccactgaccggaagctggagccatcctacgccttccctcagctctgctactcaataaatcggtgtcccttc

SEQ ID NO: 3793 - DNA, 3419 bp, Homo sapiens
gcggcccgcgagcgcgcctcacggctcctgtctcccctccctccttctctctcacgcctagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttccttta

SEQ ID NO: 3794 - DNA, 1447 bp, Homo sapiens
gagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagagcaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagca

SEQ ID NO: 3795 - DNA, 581 bp, Homo sapiens
ttcgagaatgggacatggaatgaggcgacggccccagcaagccccagcagccccagccccagccccaggcccagcagcagcagcagcagcccctgctctcccgccgcccggagaggctctgcagccatgaagccaaccgtcccgaggtaatcgcagggctggaagcccgtcatcgattctcagggaggctgtcagcgtgcaggggggagcggggagtgtcgtggagacactccgggacccctcactcggttccgctgtgcgtccacttagctgtggtgtcagctgtgtctccgctgatttcaggcaccgccggtaagcagggagcctccgcggagctcccgccgccgctcccccttggcgccaaaggcacccggtcccggagcagccacgcgcggcccgtgagcctcgccaccagcgggggctcagaggaggaggacaaagacggcggggtgctgttccacgtcaacaagagcggcttccccatcgacagccacacctgggagcgcatgtggatgcacgtggccaaggtgcaccctaaggggggagaaatggtgggcgccatcaggaacgccgccttcttg

SEQ ID NO: 3796 - DNA, 1915 bp, Homo sapiens; identical to SEQ ID NO: 3708

SEQ ID NO: 3797 - DNA, 4130 bp, Homo sapiens
agactaccggcggcgacgaccacaggagcatggcggacaccgacctgttcatggaatgtgaggaggaggagttggagccatggcagaaaatcagtgatgtcattgaggactctgtagttgaagattataattcagtggataaaactaccacagctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccagccttattttccctcctatgtgactcaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttga

SEQ ID NO: 3798 - DNA, 686 bp, Homo sapiens
agggcggcaccactccctgctccatggaaactgagcaagttgtacaggtagccaggtgtcggtctccagcctgagaactctggctgttgttccttgtgtcgtcccatattcctgcctggcctgcgatggacatcagcaagggcctcccaggcatgcagggaggcctccacatatggatctctgagaaccggaagatggtgccggtacccgagggggcttacgggaacttttttgaggaacactgctatgtcatcctccacgtcccccagagcccgaaggccacgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatctacaggaagggaggcctagcatctgacctcaagcatgtggagaccaacttgttcaacatccagcgactgctgcacatcaaagggaggaagcacgtgtctgccactgaggtggagctctcctggaacagctttaataagggtgacatcttcctgctggacctaggcaagatgatgattcagtggaatgggcccaagaccagcatttctgagaaggctcgg

SEQ ID NO: 3799 - DNA, 1495 bp, Homo sapiens
gcagccggtcgtaaccaagttgtgtcctgtcagccgctgtccccttcgccgcgatgccgctggagaacctggaggaggagggtctgcccaagaaccccgacttgcgtatcgcgcagctgcgcttcctgctcagcctgcccgagcaccgcggagacgctgccgtgcgcgacgagctgatggcggccgtccgcgataacaacttttggaacagaatccggcaagagcaaaccgaggattgccctccctccagccctagtagaggttggcattgccaggattggccgtcacgcaaacctcccaccagcatacgtttatgttttgccaagccgattattaagcgccatcgcatgccttcctacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttgtttc

SEQ ID NO: 3800 - DNA, 2069 bp, Homo sapiens
agtctcttccccaactctccccacccctggtgctctccgccccgcttgcctcccgttcttccccgcccgctccatccgggtcgctgacggctgtctctggactggacagcagtggcgtccgcttttctctaaggaacccgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagagtttcgctcttgtttcccaggccggagtgcaatggcgccatctcggctcaccgcaacctctgcctcccaggttcaagcaattctcctgcctcagcctcccgaatagctgggattacaggcgcccaccacaatgcctggctacttttcatattttaatggagatggggttttaccatgttggccaggctggtctcgaactcctgacctcaggtgatccgcctgccttggcctcccgaagtgctggaattacaggcatgagccactgctcctggcctaagatgttttttaaataatgtttttaactaaattttaagaatgtttttaactaaagttatttatatttggaataattcgttaatgatttgtgtcatttccccaacccctttttaaatttgtgaatttgaggactggattaaaagataaaaagttgttggatcttatttattttaaagtcttctggtaattgagcaagttggttatatttctgggacaatgtaataaacatagttcatttcccaggaggtttttgttttgttttgttttgtttcgttttgtttgagacagagtctcactctgttgcccaggctggaatgcagtggcacgatctctgctcactgcaacctccgcctcccaggttcaagcgattctcctgcctcggcctcccgagtaggtgggactataggggcgtgccaccatgcccgggtaattttttatatttttagtagggacggggtttcaccgtgttagccaggatggtcttgatatcctgaccttgtgatctgcccgccttggcctcccagagtgctgggattacaggcgtgagccaccgtgcccagctgacttcacaagaactttaaacttgtgtcagaaagcacatggaatggagggaactaagaattgtttctttacataggttggctttataaatatacatattccataactaataaggaatgaaggagaaagaggtagccttattaaggataaattattctcgagattcataataacctactggaggacttggcctgacaatgtagtgaatagatttaacctgtggcctattgaaaagaggtgtttctgttctggactttttagggaccacacagaaagatttaactgaattcctttattatactaaaggtgcagattatgttcatgttcatctctgttgtcttgtatatgtatgtccttttctatcactactggcttttctgaattatttccagagaagtgaatgtctgtttcactttcatgtttttttcttcataagaactttaaaatactttttaagctaatgtctcaatttttaaatttatagctaacaaatatatttaatcttcagtgcgctagaccaatccatttaaatgaattgttgtttttttatactttcaaattcagttctgaagattttaagtatgggaagtatacttttctttacaagatccttttcttactgtgtatctaatcataggtataatttggtgaccatggttatgttttgcacattgatttccatttgtttcatgttagaaacagtactaaactgttctgtgaccataatttgtaaataaagtggtgttctgtttaaaaa

SEQ ID NO: 3801 - DNA, 1046 bp, Homo sapiens
agagaattttgcaacacgtggtagtgaactgtgaggagtttgaggggtctgaagactgaaagagtcgaatggtttgttggcagtctgtgtctgtgtggagtgttgcaggacgagtggaaatgactgtttccaagttcatggcaattcagaaggcccttcagccagactggttccagtgcctctccgatggagaagtatcttgtaaggaagcaacttccataaaaagggtcagaaagtctgttgaccgatcacttcttttcttggataactgtctgcggctgcaggaagagtcagaggttcttcagaagagtgtgatcattggagtgattgaaggtggagatgtgatggaagagaggctgaggtcagcacgagagacagccaagcggcctgtgggtggcttccttctggatggttttcaaggaaatccaacaaccctggaggctagactacgcttgctgtcatcagtcactgcagagctgccggaggacaagccaaggctcatatctggtgttagtcggccagatgaggtgctcgagtgtattgaaagaggagtggacttatttgagagttttttcccttatcaagtaacagagcggggatgtgccctgactttcagttttgattaccagccgaatcctgaagagacactactacaacaaaatggaacacaagaagaaataaaatgtatggatcaaataaagaaaattgaaacaactggttgcaaccaagaaataacatcatttgaaattaatctgaaggaaaaaaagtaccaggaggactttaacccgctggtgagaggatgttcctgttactgctgtaagaatcacactcgggcatacatccaccatctgctggtgaccaatgagctgctggccggagtcctgcttatgatgcacaactttgaacactactttgggtttttccattacatccgggaagcactaaaaagtgacaaactggcacagttgaaagagctcatccacaggcaagcatcttgagatcttgcaaatacaagtctcactcttcacactgagcctgtaccactg

SEQ ID NO: 3802 - DNA, 627 bp, Homo sapiens
acatgtttcctttgttgtgagctgcggcagagactggtggctggaggagacgccggcgctggagagtgcgctgcgccgcccgccgctgagggaccgcggggttagccactgctggctgcttccagtgttcgccgagaggtaccgggggtgacagctccgggaccggccgaaaggcgaggaaccgccacataaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttccttgccatagagctgtgctctcagcctgtagcagctacttcagagctatgttttgtaatgaccacagggaaagccgagaaatgttggttgagatcaatggtattttagctgaagctatggaatgttttttgcagtatgtttatactggaa

SEQ ID NO: 3803 - DNA, 1815 bp, Homo sapiens
agaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggatttccaatttccaagcctgatgggatctcccagctggaacaggatctacaggtctttgatctggaaactaagactagagaagtcttaagagatgactgctcagatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagat

SEQ ID NO: 3804 - DNA, 544 bp, Homo sapiens
acaactggagcagccgggaacagctctgaccacagtggttccggggagaagcctttccaggacccatgtgtaggcacaactgttttccctgatcaggatacttgcggcactcaagaattctccgaagtttgaaggttatgaatggttatcactcaaggattcagaactaagatactttcccagcaacatctagactgctgtttgaccaaacaacggggctccaacagcctagccaagtgaaacataaaactaaccatcacagtatccttgtcaaaaatcagtctgacaacacatcagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctctta

SEQ ID NO: 3805 - DNA, 4476 bp, Homo sapiens
ataggtgcattgtgggaagcactttgctgtccacagccaggccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagtttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagtgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggcttttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcatgatctcagctcattgcagcctccacctcctgggttcaagtgattctgcctcagccccttgatcagctgggattacatgcatgtaccaccacacccagctaattcttgtatttttagtagagatggagacagagtttcaccatgtaggccaggctagtctcaaactcctgacctcaagtgatccacaagcctgggcctcccaaagtgctgggattacaggcatgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacacctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttacaaaaattgcgca

SEQ ID NO: 3806 - DNA, 2117 bp, Homo sapiens
gcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagagcaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaa

SEQ ID NO: 3807 - DNA, 4294 bp, Homo sapiens
gggcaccagagtgccgagcccaggacgcccccggcccaggcccttggggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctggtacctgtgccagagccagtgcccctcaccaggggcttctggccctgccttggcccctgggaccctggcccagtccctgccaggatccggtacccaaaggccctacacccagccgcacgtcccccaatatcgccggtctgcatggagcgccatccctctcctctgccctgactcctcctccccgccacgaagtgacctggggtcctaccccttcctgcctccagagaagctgggggcgggcttctggggcctggggcatcccagcacagtgtgtgggaagctgggggagtcttccagctgctgggccagaacctcccccagccaatttggaggttccggggaggggccctagctggcacggggtgggacttgggttgctacactgccctctgaccactgcccttaggctgcagatcccacagagccctggggggcggggagcggtagccattctgaggactcggcctcctcccaccctagccccctcaggatgctgtcctaatcctgggccagtattgacgtgcagtcctgccgtgtgagctcgggagagccccttgccctcctggggactgtttccctttcgtaaactgggaggctgtctctgggaatggatatcttctctcgttctttcttgctcatcaactctgcttcagggcctggggcagcaggatccccagaggggatgtggggggggcactggggctcccaggtaaggtggcactgagttggggcctctccccacagtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccagtgaggtggctccctcctgcccccctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgt

SEQ ID NO: 3808 - DNA, 2552 bp, Homo sapiens
cgtctattttcctacgactccagctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctggccttcttcctgccacaggccatgcctctaccaaggacacatggcctttccctgttaggactgatggcggttctttcctatctcattacccgctaggggcctgggagccctgtggctggatctgagtgctcctgagctggcttcagctgcagaactctcagtccctcatcagatcgagactctatttcccccgtcagtctgggggcttcacaagggcaggagagccctccatcactgacttccagatcagggaccctgccaagtagggactgtcttctcagccagccatttattagtctaatattccttcactaaattccaactctatgtctggacctgtgttaggcacttcagataccacacgagtaagacaagggccctgcaggggtggtcctttggtggaaagctggtcttaagggttgggcttgggaataggcagggtcagattccagggcatggctctggactcagctggtttatacctatatgaccattacaattgtctacagatcacatccattctggctggtcaacatgcatgctgtactggctgttaaataaaaatattctgaatgtcactccttttgagggacagcacagccttccctaggcattctcctatattccccagccaaattgtagagtcagatgcacccacatttgcctgtgtccttgatttagcaggaaggaaaggaatagtcagggttgatggatgcccacttctcttctctttctcttggtcaactcaggagccttttagtctgagggaatggagaggcaaagaaagaagggagagtaatagaattgggagggcagagacttaagggttctgcttcccagccctagaaattctatcattgctcagccccaatgagaaagcagatacacctaagccatcatcaaccactaacatctcaacttgccagttgctgggtgctgggccctggcaggaatgggccaagccaagcaggggagactagagagcaccaatggccaacacagctgcctggctggggaggctgtgctgtttcccctggagacctgactggtctgtggttcccacaggaacagggttgtcttttgagcccccagtgtctggtttcattcatctcagacttgttatttcactcatctctaataaaggattggggggtcagtt

SEQ ID NO: 3809 - DNA, 813 bp, Homo sapiens
atggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtctaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataa

SEQ ID NO: 3810 - DNA, 542 bp, Homo sapiens
atgtatgtcctcacaatgcaggaggtgaaatgtgtatgtcatgtgtccaaattgtaagatacttgctatactttcccagcaacatctagactgctgtttgaccaaacaacggggctccaacagcctagccaagtgaaacataaaactaaccatcacagtatccttgtcaaaaatcagtctgacaacacatcagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagca

SEQ ID NO: 3811 - DNA, 569 bp, Homo sapiens
atgcgcgctgcagcccgcggcccccgagagccgcgcttttgtaagagctggccccttacatatggaaatgacgctcacgcgggtccccattcgcgtccttttgaaggacgcccgcccggaaccgctgcgccggctgcgaagtattgtcccgtttctccagccctaacaaagcgtcctccttcgctttgcagagcgctggaggcgggctgccggctgtgcgggcgctccggagagaccgacagaaggtgagcactgtgggctatgggatggatgaggtggagcaggaccagcatgaggcccgactcaaggagctgtttgacagttttgacacgacgggcacagggtccctggggcaggaggaactcaccgacctttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggt

SEQ ID NO: 3812 - DNA, 1186 bp, Homo sapiens
attcgcctccatggcccactcgccggtggctgtccaagtgcctgggatgcagaataacatagctgatccagaagaactgttcacaaaattagagcgcattgggaaaggctcatttggggaagttttcaaaggaattgataaccgtacccagcaagtcgttgctattaaaatcatagaccttgaggaagccgaagatgaaatagaagacattcagcaagaaataactgtcttgagtcaatgtgacagctcatatgtaacaaaatactatgggtcatatttaaaggggtctaaattatggataataatggaatacctgggcggtggttcagcactggatcttcttcgagctggtccatttgatgagttccagattgctaccatgctaaaggaaattttaaaaggtctggactatctgcattcagaaaagaaaattcaccgagacataaaagctgccaatgtcttgctctcagaacaaggagatgttaaacttgctgattttggagttgctggtcagctgacagatacacagattaaaagaaatacctttgtgggaactccattttggatggctcctgaagttattcaacagtcagcttatgactcaaaacgtcctacagcaaaagaacttctgaaacacaaattcattgtaaaaaattcaaagaagacttcttatctgactgaactgatagatcgttttaagagatggaaggcagaaggacacagtgatgatgaatctgattccgagggctctgattcggaatctaccagcagggaaaacaatactcatcctgaatggagctttaccaccgtacgaaagaagcctgatccaaagaaagtacagaatggggcagagcaagatcttgtgcaaaccctgagttgtttgtctatgataatcacacctgcatttgctgaacttaaacagcaggacgagaataacgctagcaggaatcaggcgattgaagaactcgagaaaagtattgctgtggctgaagccgcctgtcccggcatcacagataaaatggtgaagaaactaattgaaaaatttcaaaagtgttcagcagacgaatccccctaagaaacttattattggcttctgtttcatatggacccagagagccccaccaaacctacgtcaagattaacaatgcttaacccatgagctccatgtgccttttggatctttgca

SEQ ID NO: 3813 - DNA, 708 bp, Homo sapiens
gggcccgagaccccgcctctcggcgagcccgccctcttctgaagaggcgtttctggaccactgagccccgcctcccactgcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggat

SEQ ID NO: 3814 - DNA, 795 bp, Homo sapiens
gccgcgcgctgcagctcgagttcgggccgcgggggaggctttggagcggcgccggcggtggctcggccggctcagcccctccgccccgcgtccccgccgtgcgcggccttccctgaggcgggcgtccgcgtgggtccgggatcgcgtggccgggcggccgggcgcactcccgggattccaggcttccggggtggcgggcgaggcccagaaagcaccaggccacccggccgcgccggcacccgccgcgtcctgcttgacagaggctgatggacgtgtatttctccacgctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactccttactgcagagtgggtctgggcatctgctacgacatgcggtttgcagagcttgcacaaatctacgcacagagaggtgaggcagt

SEQ ID NO: 3815 - DNA, 576 bp, Homo sapiens
gtttagctcctgggaaatgatgagattgatgattctttctcctggaaaacctttcatcacagagattcatctcagctgaacactgaacagcttagcagaggccttctgtcctctcttatctcatcaccagaggattttcctcccttcttttcatccttgctgtgatctatgcaaacagctactggccaaagaagagcttagcagagggggaggactccaagtctgagctttgataaattctggaaatgaggggattgttatctggaaaaggcgtacatttgtattctctagcattaaagggcagtatttaaagtcagttggcaagcagtggaataagatttttgtaaagaaaccttgtgcagcatggattctctaccagatgaattttttgtgaggcatcctgctgtggaggatcagaggaaggaagaaactgagaataagctagaaaaatcatctggtcaactgaacaaacaggaaaatgacatacctactgatcttgtccctgttaacctactattagaagtgaagaagttattaaatgcaattaatactctaccaaaaggtgtggttcctcac

SEQ ID NO: 3816 - DNA, 3022 bp, Homo sapiens
gttttgtttgttgtggttttgatgttttttttcctttcagctaaaggagcagcccagtggttttcaagaagtgctaaagtgcactgactgtctcatgatgactggtgcctcagggagggtcatgattcctggatacaggatcgacctgatcctggatgtcacttcaagcagtcagatcgtggggaaaagccttgtctaatggctagccttcctcaaaagtctgatgctagtcatctcggaaggcctcagaaaaagccttaaagcttcatttacctcttaattctcctttgcctggaagtgaattgaccaaggaaccttttcgttgggatcagagactctttgcattagtgttgcggttgcctggcaccatgtcagtagaatcagaacagttgacaggtgtgcctttagatgactctgcaatcacaccaatgtgtgaagtgacaggcggccgttcatattctgtgtgttctccaagaatgcttaatcagtgtctggagtccttggtgcagaaagtacaaagtggggtggtaataaactttgaaaaagcaggaccagatccttcccctgtagaagatgggcagccagatatatcaaggccttttggatctcagccttggcatagctgtcacaaactcatatatgtcagaccaaatcctaaaactggggttcctataggtcattggcctgttccagagtctttttggccagatcaaaattcgccaacactaccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtgtacgtgagcaatagtgcaaaatacagtgaacttggtcatccttttggttacttgaaagccagtacagcactgaactgtgtcaacttatttgtgatgccttacaattatccagtccttcttcccctcttagatgacttgtttaaagtgcataaagcaaaaccaacattgaagtggagacagtcatttgaaagttatttgaagacaatgcctccctactatcttgggcccttgaagaaagctgttaggatgatgggagcacctaacctaatagcagacagtatggaatatggacttagttacagtgtcatttcatacctcaaaaaactgagtcaacaggccaaaatagaatctgatcgagtcattggatctgtaggcaaaaaagtagtacaggagactggaataaaagtccggagccgatcacatggtttatcaatggcatataggaaagattttcaacaactcctccagggaatttcagaggatgtccctcacagactgctagaccttaatatgaaggaatacactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctccagccagtttactggaacggccaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagaggtcaatactgaactaaaagcacaaataatgaaagagatccgaaagccaggaagaaaatatgaaagaatcttcactttactgaagcatgtgcaaggcagtttacaaacaagactaatatttttacaaaatgtcattaaagaagcatcaaggtttaaaaaacgaatgctaatagaacaactggagaacttcttggatgaaattcatcgaagagccaatcagatcaaccatattaatagcaattaaaagaaaatagaatgtggccacttatttcactatcttcttcaaatacaaagtaaatacaagactgttgtgatcttgcattcattttctgacatgcattgttggctatttgaaatactaaaagcaaatctacagatcctttttccatcattttacagtgaccttttcttcattttggtttatttttgtaatgtgaaaagtatcactctaaaaaacatttttaatttaacaaactaaaaatattcctccaaatctcttgcttgtcattgactcttgcgtgtcaatttccctcaggttctattttcttaaaccaacctttaaaattgtcacctctgttaaggttgaactttgccaaaaaaaaaagaagttactttgtaatttttggggaaaaaagcacatacattaaaactaggtaatgttttgtatatacagttattttggatatattattgtaagttgtacaaatgtattttgaagaatatttaagaaaagcacttttgttattccatcaataaatgctctatttt

SEQ ID NO: 3817 - DNA, 561 bp, Homo sapiens
gatgccatccttctcaaaagacttattgacagtgccaaagctcggtactggacacaacgagggacctgggtctacgataacgcgcttttgctcctcctgaagtgtctttggtccaacgttgttccaggtttgtcaccgtttctctccggccggtcagggcaagagccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggt

SEQ ID NO: 3818 - DNA, 942 bp, Homo sapiens
agttgacgcgggggcggggagtcagcgagggcgagcctactggagtttgccgggggtgggaagaaggtgggcctcgagcaaagccgctagaggtggggtgcgggtggtcggcctcaggcgagccccggggcacagcccggggcgggaggcggagcttggcggccgagatctccgcgctgcagttagccccgccgagcgccaggagctgcggactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccc

SEQ ID NO: 3819 - DNA, 508 bp, Homo sapiens
ggattgatcctgctggccgcagccacccacgtggtggaagcccggccctgcaggctggagaggatttgattagactacgcgtttcgacttgcagggtgtttaatcgtcgccaagcgggacttactgcaagctatcaaatctgaggtcttattttgttgagtcgaaagtgaaattttcctttggccaacgtgacagggctttgtttggtggtaaaaagggttactagacacccctcattccactgccactggagggcgcatttctcagctcttgctcttcaaacctgctgaaaggaattcctagatctaaacaccagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttat

SEQ ID NO: 3820 - DNA, 829 bp, Homo sapiens
gtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactt

SEQ ID NO: 3821 - DNA, 599 bp, Homo sapiens
gacctttggcctgactcacaggacactaaggctccttttctgaagaagccttttaccagtctcatttaggggatgggaacaacatgtcttcacctagggactttagagcagagcctgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgca

SEQ ID NO: 3822 - DNA, 693 bp, Homo sapiens
ctgtggctctgtggtaggggaatgccaccaactccctgaggagcagccgtgtggtatgattggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 3823 - DNA, 678 bp, Homo sapiens
ggcatcgtctgtaaagaatgagcccttattagacactgaatctgccagcaccttgatcttggacttcctagcttctagaactgagctgtatttgatgaaagtactagaaaaatactggttgtacaagatcgaaataaattgaaaaatatgtggaagtttccaggaggcctgtcagagcctgaagaagatattggagacacagcggttcgagaagtttttgaagagactggtataaaatcagaattcaggtccgtcctgagtattcggcaacagcacacaaatcctggagcttttgggaagtcagatatgtatatcatctgccgcctaaagccatattcattcaccataaatttttgccaggaagaatgcttaagatgtgagtggatggatctcaatgacctggcgaagactgaaaatacaactcccatcaccagcagagttgctaggctgctgctgtatgggtacagagaagggtttgacaaaattgacctgactgtggaagaacttccagcagtttacacaggactgttttataaactctatcataaggaactgccagagaattataaaactatgaaaggaattgattaaattcacatttatatgtttagaaacatgtagactaacgaatgacataagaaatagtggacattttggattgattaaacatctgactgt

SEQ ID NO: 3824 - DNA, 487 bp, Homo sapiens
gcggccggcgcggggtcgacggggacccagcgtcggcggacccctagccgcggagaaggcggtggtctcgacattcccccatccccgccctggagcaaagtctgaaatggatgttacatgagtcattttaagggatgcacacaactatgaacatttctgaagattttttctcagtaaagtagataaagatggatgaatcagccttgttggatcttttggagtgtccggtgtgtctagagcgccttgatgcttctgcgaaggtcttgccttgccagcatacgttttgcaagcgatgtttgctggggatcgtaggttctcgaaatgaactcagatgtcccgagtgcaggactcttgttggctcgggtgtcgaggagcttcccagtaacatcttgctggtcagacttctggatggcatcaaacagaggccttggaaacctggtcctggtgggggaagtgggaccaactgcacaaatgcattaaggtctca

SEQ ID NO: 3825 - DNA, 4207 bp, Homo sapiens
gcggcggcgaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacagaggggcgttcctgcaatgagtcctgatgctttaaaccagttcccagcagctcctattccaactttaagtggcttttctatgactctgcctacaccggtgagtcagccaactgtgataccttcaggtcctgcgggctccatgcccctcagccttggacagccagtcatgggcattaaccttgttggaccagtgggtggagctgcagcccaggcttctagtggtttcataccaacctaccctgcaaatcaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcagatatagaggacttaaaatatgctgcttttggaagctacagtagcaattttgcagtgagcacacttacaagctatgactggtcagacagggatgatgcaactcagggcagaaaactctctccatttgtcctctcagcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacaccagatgaaaactcgctggatttttcctcctgtatgttacggcctgggattaaaaatgctcaggagcttgcctgtggagtgtgcctcttgaatgtggactcgaggagccgggcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggtgacagggaccaataaatagaatgcgagcactgcacagttcgcttccctgaatcgatatgaagaacaccgcaagggacggggcccccgtcatccccacggccagtctgcaggacttcaggtaaaattgtcccacccaaactgcacgtggcaccagaagcttgctcacttatctctacttaagattttctgaaatacggaccacggctttcttgatctaaggaagaacttgctgctgcagtattgaaactgtgaagaactgacatttgaagaaaaatagattaccgttgcgggactagaatgggcgactgcttggagccagtgcttgtttttatctaggacacttactgtcctgtgaagtagaatacatttatctgcatttagtttgttaatgtctgaaatgaataaaaagaggaaattgcgattaaactgatgttctgctttttat

SEQ ID NO: 3826 - DNA, 560 bp, Homo sapiens
ttttcttcctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgctggagtacaatggcaggatctcggctcaccgcaccctctgccttccaggttcaagtgattctcctgcctcagcctcccaagtagctgggattataggcatgtgccaccatgcctggctaatt

SEQ ID NO: 3827 - DNA, 854 bp, Homo sapiens
ctgtggctctgtggtaggggaatgccaccaactccctgaggagcagccgtgtggtatgattggtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatgttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 3828 - DNA, 724 bp, Homo sapiens
taatctcagtatttgtcaggattttgcttttcctgacttgctttgcacagaatgttccctggatgaaagcccagaaatcaccaacatttcagacaatgctttctgagccttactctgttccacatttcataacaggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaag

SEQ ID NO: 3829 - DNA, 401 bp, Homo sapiens
ctgtcaggttgccgtctaggtagcggttgtgcttgctgaggctgcacttgctgacactgcagctgcgacgcggctaagaggcgcagagcgaggagtcgggatttggtcgcgagcggcgacggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttc

SEQ ID NO: 3830 - DNA, 1626 bp, Homo sapiens
tggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtttccagtttgtttcctcgtctcttccagacatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaa

SEQ ID NO: 3831 - DNA, 760 bp, Homo sapiens
ttcatgtcttcttactcagttgtcaatttctcagtaaccttatatgaccaccttatttaaaattatattgtccttgccctagcatttcctatgtttcttccttgtcttttctccatggcacttataaatcatttgatatactacagtatatatatgttttattttttattttattgtctgttttccttacttagaataaggttcacggtaggagggatttttgtctattttgttcattgctatattcttaccccctagatgagtatctggcaggtaataagtgttcaaccaatactgctgaatgaataaatattttttgctttagtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacag

SEQ ID NO: 3832 - DNA, 2034 bp, Homo sapiens
ttcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaaggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgagaggggtggggtgttccctcttctggttttgccatccctcctgcagcctaaagggctccaattaggctgccctgcttgcttgcttgcttttgcagggttaggggaaggttactaggatggctcacaggctagagagaagtcctaactgcttaactttaaaatacatagagttccttggccctcatggctatttttcagggcttctggtagtgggagtcaatttgattctatttgtgcctagaaaaataaagaatgatgtgctggtgaatcttgggtcacctatgtactatactataattgaaccttacctggggacccacacgttcaggctcaggtgttttgtttcttagagcctttgttaagtttcctacgtgtgcgacattcctaaggtcttcaagtttcctattctgttttgtgctgtgtgaaagttctgatatgacccctgatgataaagtccataactgtagttaactggtcatcactgctca

SEQ ID NO: 3833 - DNA, 732 bp, Homo sapiens
tggctgtagcgactggttgcgggaggctggactctggtgactgtgtatggttgcatatgctccgttttcctctccctgtcgtgctgggcctttgaaaccggcttctttgctggtggctgcttgctctgcttgtattactcttcaaaatatttattcactggtactgaagagagacataactttgttgtcagaaattccattatcagaggtagaaatcatgtaagagacactgaaatgttttccaaaatgtcagaaaaaggaaaggtgaaaaattagacgatttcaagaattggagctgaatctgatgttaagtaatggcaacaggtgacttaaaaagaagcttacggaacctagaacaggtgctccgcttgctaaattatcctgaagaggtggactgtgtaggtttgataaagggagacccagcagcatctttgcccatcatcagctattcttttacctcatactcaccttatgtaacagaacttataatggaatccaatgtagagctcatagcaaaaaatgacttgcgctttatagatgctgtctataagcttcttcgtgatcaatttaattataaaccaattttgacaaaaaagcagtttatccaatgtgggtttgcagaatggaaaatccaaattgtttgtgatattttgaattgtgtgatgaaaaagcacaaggaattaagcagtcttcagaagattccatcacaacaaagaaagaaaatcagttctg

SEQ ID NO: 3834 - DNA, 891 bp, Homo sapiens
gattccacactgaggcgagcgcggcggccggggtggtagtggcagtgttcgtgtgctcaggtctgaatcgccgagggaggaggcggtggaggaagaggtggcggcggtggcggtggtcgtagcggtggcggaggaggcgggtacgaatcagctgcgggcggagacatggccaacatcgcggtgcagcgaatcaagcgggagttcaaggaggtgctgaagagcgaggaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgct

SEQ ID NO: 3835 - DNA, 1071 bp, Homo sapiens
attccattcgcgctccgcggcgcgaggcaatcgtccggtgtgtgagcccgggagccggaggtgtagcggcagagacattgttcttgccggctccctacggtgccgtgtgtgcgtgagagaagaccagtctttcctctaggttaggccgggcacggtggctcacgcctgtaatcccagcactttgggaggccgaggcgggcggatcatctgaggtcaggagttcgaggccagcctgaccaacatggagaaaccccgtctctactaaaaatacataattagccaggtgtggtggcgtatgcctgtaatcccagctactcgggaggctgaggcaggagaatcgcttgaacccgggaggcggaggttgcagtgagctgagattgcgccattgcactccagcctgggcaaggagagtgaaactccgtctcaaaaaaaaaaaaaaaaaattatttcagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctg

SEQ ID NO: 3836 - DNA, 569 bp, Homo sapiens
ctcgaatgcagcgtctacgcctggtgaatggacgcactcttaccaattctgctctgggagatgcagcggtaacctaccgagcgcagaggccggcgcgcacccgtggagcccgcgctcgcgatccctcctcgtgccagggccccagggcagtcaaggcctgccgaccgttaggcgggtcaaggggtacacagggtgcgaattcgttaggcaaaagctgggtacaggcgcgagccacaggcacggaaacctcgcgccgaccggggccctaggcccgacgacggcagctgaccagcttcggccggtttggggataaagggaagacaggcggcgcggggagtgggaacgcctgaaggccgcgcccctcctttcaggtcggccaggagcgcgccgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagag

SEQ ID NO: 3837 - DNA, 1475 bp, Homo sapiens
ggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggccaaaatcctgagcatgatggaagacaataagcagctcgcgctccgcatcgatggggcggtccagtcggccagccaggaggtgaccaacctgcgagccgaactcacggccaccaaccggagactggcggaactgagcggcggcggcggccccggcccgggcccgggagccgcggccagcgcctcggcggcgggggactcggcggcgacgaacatggagaacccccagcttggagcgcaagtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcgccatgccgggcgagacggtgctcaatggcaaccaggagtgggtggtgcaggcggacctcccgctgaccgcagccatccggcagagtcaacagactctctaccactcacacccccctcaccctgcggaccggcaagcggtcagggtgagcccctgccactcccggcagccctctgtcatctccgacgcatctgccgccgaaggcgaccggtcgtccacaccgagcgacatcaactcccctcgacaccggacacactccctctgcaacggcgacagtcccggcccagttcagaagaacctgcacaaccctattgtacagtcactagaggatcttgaagaccaaaaacggaaaaagaagaaagagaagatgggattcggctccatctcccgcgtcttcgccagagggaagcagcggaagtccctcgaccccggcctctttgatggtaccgcccctgattattacatagaggaggacgcggactggtga

SEQ ID NO: 3838 - DNA, 4534 bp, Homo sapiens
gacgttaggctccgactcttaacggagacgcatttttatttctgttgtttacgattcgctatagattccttgtttctcacttcgtagcacgagccactctgaccatcaagatcagaaaaacttctcagctgcaagttagaagtggactggccattgaggaggctctcagcggagtcgctcttcacaggagtcttgaacgcggtgtggaatcggcagcgaggaatcctggagcacagagaagctcccagctttgaaggtcttgcggtgaagcatcaagtgtacctgatttgtgaacctatcttgcttcagttggtttcctcctaaatattaggcagatgggattggctggtctgtgctctgctaggtgaaaaattagacgatttcaagaattggagctgaatctgatgttaagtaatggcaacaggtgacttaaaaagaagcttacggaacctagaacaggtgctccgcttgctaaattatcctgaagaggtggactgtgtaggtttgataaagggagacccagcagcatctttgcccatcatcagctattcttttacctcatactcaccttatgtaacagaacttataatggaatccaatgtagagctcatagcaaaaaatgacttgcgctttatagatgctgtctataagcttcttcgtgatcaatttaattataaaccaattttgacaaaaaagcagtttatccaatgtgggtttgcagaatggaaaatccaaattgtttgtgatattttgaattgtgtgatgaaaaagcacaaggaattaagcagtcttcagaagattccatcacaacaaagaaagaaaatcagttctggtaagtcagaacctcctttgggcaatgagaaaatatctgcagaggctgttggcgttgatatcagtggcaggtttatgacctcaggaaagaagaaagctgtggtgattcgtcacttgtataatgaagataatgttgacatttctgaggatacattaagtccaataacagatgttaatgaagcagttgatgtgtctgacttaaatgctactgaaataaagatgcctgaagtaaaggttcctgaaatcaaggctgagcaacaggatgtaaatgttaatcctgagattactgcactacaaactatgcttgctgaatgccaagaaaatcttaagaaactgacttcgatagagaaaaggttagactgtttggaacaaaaaatgaaaggaaaagtgatggtagatgaaaacacctggactaatcttcttagtcgtgtcactcttcttgaaacagaaatgcttttgtctaaaaagaatgatgaatttatagagtttaatgaagttagtgaagactacgcttcttgtagtgacatggaccttctgaatcctcacagaaaaagcgaagtagagaggccagcaagtattcctctgtcctctggctatagtacagcatcatcagattcaactcccagagcctctactgttaattactgtggtttgaatgagatttcagaggaaacaacaatccagaaaatggaaaggatgaaaaaaatgtttgaagaaactgcagagttactgaaatgtccaaatcactacttgtaggattttctacatgaacttttttctaggactttggttactatacatattgtatattttaagaattctttatacaattttaatatactgcaatactgcagtttttgacaatttggattccatttggtatatgaatttttgcattcattattgaataactcttttaatatttttgagcaatgattatactgctttaccttgtgtcactttttttttttttaggaaaaactcatgttccagtatatttctcttacagagtgaagtcattacagcactgtatttctgtgttgacatttgttggcagtgtgctaagtaatgttttttaaagcacaggcttgaggactatggtttacatcctgttggaaacattccaaatgggacttgtgtattatacccaggaggctctcatatataccatcttggcatctgtactgatgaataagttataatgaacagttaaaaatgctcattgaaaattaaataaaacaaaaaggcagttatttcatgcttggtcaaaaacatcaatacctttccaattaacactgagaaattaaggttaagattctccttttgtactgggaaacaggctggaggactatggtcctcaagtttagaccaagaggactatggtctcaaggttcaccatgagaaatgtgttgaacattttagtatgctctattgtataatttttttggagggggggatggagtttcgctgttgttgcccaggctggagtgcaatagcacgatcttggctcaccgcaacctctgcctaccgggttcaagtgattcttgtgcctcagcctcctgagtagctgggattataggcatgcaccaccatgcccagctaattttgtatttttattagagacagggtttctccgtgttggtcaggctggtctcaaactcctgacctcaggtgatctgcctgtcttggcctccggcgtaacactttttaagaccagtgtaacagaaagagaatgtagccattctagccaccgttaaaagatacacagtgaggtgttgtgttttgtttttttaatgatgaaaagttacacattttttggagagaaaagtcttagctgaaggtaaatcaatggaaaaatgaaatttatttttaatattactactatatgaattatctttttttaaacttgtagataaaagtgttccagtaatcagaaaatcctcaagaaaattgacttcattatttggaaggaaaattagtattttttttaatattatatggaccatctgattatattttatttattcatctatttatggtatgtatgtataattctatattacactgtcaaatataaaatattgttatatgagtagaaatcacttaaattttttttgtgtttgtgaatttgaaacagtgtaagaaatcacttttaagaaaacatttttagaattcctttgttttttttttttttctttttgaaacagggtctcactctattgcccaggctggagtgcactggcgtgatctcggctcactgcaccttctgcctaccgagttcaagcgattcttgtgcttcagcctcctgagtagctgggactataggcctgtaccgtcatgcctggctaatttttgtatttttgtagagacagggtttcaccatgttgcccagtctgttctcaaactcgtgagctaaagctactcgcccacctggatgtcccaaagtgctagattccatgggtgagtcaccatgcttggccacatttttagtattctaataaacagttggtcatcagaactttaaaatggtagcctacagaaacatacaattttgaatttaacagagtttcagtaaatatttccagaattaatgaagcatgttagctttaattttttcaattgtgagagaagtacatttataaaaattaagaggttaagaggttatagttataagggaaaaaacttctgtatcgattaactcctaaaatatcagtaccagcatggaattatagcaccaccttgtggttaacatgccagtattttaccttttgttaaaacaagtgatttcccatcaaacaggataatattttttcccttttgaaaaattcaattttaaaaagaaacatttttgaagttttcttatggaagatagaaaaaaagttaagtctctttctaccctttctttttttctttatatagtgcagatatacacacagagaagggacttaaaacatttctaatctcctagtttatatacagtgtgcaaaatataagtaagtatatattgaaaatataaaatatttcatatatgttatcaggtggaaatttagaatccaaattttcttaaactttaataacttgtctaacaactctctaatagggactaaaaatcaactcaatatatcatacatttacacttacaaagagtctttatctagacaacataatttttggaaaaataaagcaaattcaactttattggagttattggacagatcagcaaattgttattttaaaaagttttcttgtttaggcaatttggtaagtggtttctagttataaactagccactgttgattaacttgagaaggtgaagcaggggagttctgaagagattacctagagctacataaccctaagttaagtaaaattttcactttcattcttttcattctctcataaactggttgaaaaaacactgtactaccaacaaaggtgtcagttgcttgtgctgccctgtctatgttatgctctgaataggtctcggtaaagattatatggaaatactataaagaatacataaggtaaaatactagtcagaaagggttcagaagaagttagcatcaactgtatgaaaattctaggtaaagctaagtactattgagttggaaaaaagtaattctatcatgtttgcttgttttcctctactgtttttaatgtgatgttgtaatatattttaaaaataaaacttgaaaacgttggg

SEQ ID NO: 3839 - DNA, 584 bp, Homo sapiens
gcgcgtgtgtccgcgcgtgtccgcgtgtgggtccgtgtgcgcgtcccggtcccgcggcggcgacggcggcggcggcggcggcggctgcaggacgagccgagaggctcagccatatttgatggttttgttgctttgctcgggagttctcgggagtaatttaatgccgaaggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtgga

SEQ ID NO: 3840 - DNA, 896 bp, Homo sapiens
aattcctccctgcagtttgaaactgtcaggttgccgtctaggtagcggttgtgcttgctgaggctgcacttgctgacactgcagctgcgacgcggctaagaggcgcagagcgaggagtcgggatttggtcgcgagcggcgacggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaact

SEQ ID NO: 3841 - DNA, 545 bp, Homo sapiens
ctgtggctctgtggtaggggaatgccaccaactccctgaggagcagccgtgtggtatgattgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 3842 - DNA, 570 bp, Homo sapiens
gtttgttgtggtgacgagctgtgagcaatggcctgtgtttatgctgggcgagctttctttcctacttggggaggggggttcaggatgggaggatgcgggtagggaagagggggggaaaacccccaagctccacaacattttaagttttttgaagtcattccaaataaatctaagtgaactattgattttgatacaaagcaacagcctctgccacactgaagaagtgagctttaagcagagactagaagggtatggcatcacagctgcaagtgttttcgcccccatcagtgtcgtcgagtgccttctgcagtgcgaagaaactgaaaatagagccctctggctgggatgtttcaggacagagtagcaacgacaaatattatacccacagcaaaaccctcccagccacacaagggcaagccaactcctctcaccaggtagcaaatttcaacatccctgcttacgaccagggcctcctcctcccagctcctgcagtggagcatattgttgtaacagccgctgatagctcgggcagtgctgctacatcaaccttccaaagcagccagaccctga

SEQ ID NO: 3843 - DNA, 567 bp, Homo sapiens
agcccagcgcctcggccgaacccctccgcagcagttcatagccctgatgaagcaagttactctgctctcctaataaatgcaagaaaatgaccttggagggcctttttaattacacatagaagtgacaatttgctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccggacgctggctgacag

SEQ ID NO: 3844 - DNA, 578 bp, Homo sapiens
gaagcagttgagtgctgcagcggcagtcgtcgcccctgccgccgctgccaccgaaggaagcatcccagacaccgggaagagacagggtttcaccatgctgtccaggctggtctcgaactcctgatctcaagtgttccgctcgcctcggcctcccaaagtgctgggattacaggcgtgagccaccggatggaagatggtaccccaaagcatatcatccagatgacaggatttaagatggaagaaaaagaagcgctagtcaaattacttttaaaactagattgcacttttattaagagtgagaaatacaaaaattgtacacatcttatagctgaacgcctatgtaagagtgaaaaatttttagcagcttgtgcggcaggaaagtggatactaaccaaggactatataattcatagtgccaaaagtggcagatggcttgatgaaacaacttatgaatggggatataaaattgaaaaagattcccgttattcacctcaaatgcaatctgcacctaaaagatggcgtgaagaactgaaacgcactggtgctccaggagccttccacagatggaaagttgtcct

SEQ ID NO: 3845 - DNA, 8843 bp, Homo sapiens
gtgtgtgtttcccctgccgcggggaaatggctgctgttgcttctgggccagaggaagagaatgaggtagagtgttcttttgcctccgagtaggaccgagagtgttgggaagaggagcgcgtccccggggaaatgagactaatagggatgccaaaggaaaaatatgatcctccagatcctcgcagaatttataccatcatgtcagcagaggaggtagccaatgggaaaaaatctcactgggcagaattagaaatctcgggtagagtgcggagcctaagtacatcactttggtcattgacacacttgacagcgctgcacctaaatgacaattaccttagtcgcattccacctgatattgccaagcttcataatctggtttacctggatctgtcatccaataaactcagaagtttaccagcagaactaggaaacatggtgtctctcagggaattgcttttaaataacaatctgttacgggttttgccttatgaacttggtcggctcttccagctacaaactctaggtttgaaaggcaatcctttatcacaggatattctcaacttataccaggacccagatggaacccgaaagctactgaacttcatgcttgacaatctcgcagttcatccagagcagcttcctccgaggccatggattacattaaaagaacgagaccaaattctgccgtcagcatcattcacggttatgtgttacaatgtgttatgtgataaatacgctacccggcagctatatggctattgcccatcctgggcattaaactgggaatacaggaaaaagggaattatggaagaaattgttaactgtgacgcagatatcattagtcttcaggaagtggaaacagagcaatacttcactctctttctgccagcattgaaggagcgtggatatgatggatttttttctccaaagtcacgtgccaaaatcatgtctgagcaggagagaaagcatgtagatggttgtgcaatattcttcaaaacagaaaaatttacattggtgcagaagcatacagtggaatttaaccaagtggcgatggctaattcagatggatccgaagctatgctgaacagagtgatgacaaaagataacattggtgtcgctgtggtattagaggtccacaaagaactatttggagcaggtatgaagcctattcatgctgcagacaaacagctgcttatagtggcaaatgcccacatgcattgggacccagagtattctgatgtgaagctcatccagaccatgatgtttgtctcagaggttaaaaacattctggagaaagcctctagtaggcctggaagcccaactgcagatcctaattccatcccgctggtgctatgtgcagatcttaactcattgccagattcaggtgttgtggaatacttaagcaatggaggagtagctgacaaccataaagacttcaaggaactaaggtacaatgagtgtcttatgaacttcagctgcaatggaaagaatggaagctcagaagggagaatcacacatggcttccaacttaagagcgcctatgaaaataacttgatgccttacaccaattacacctttgatttcaaaggcgtgattgactacattttctattccaagactcatatgaacgtgcttggtgtcctggggcctttagatcctcaatggctggttgagaacaacatcactgggtgtccacaccctcacatcccttcagaccacttctcactgttaacacaacttgaactccaccctccactcctgcctcttgtcaatggtgttcacttgcctaatcggaggtagtggagtactgccccgccaagacggggatctgttgctatggacctgtacagttgtaaatcaaagtatgtaggagtgaagtatggccatccttaagctgcttcttcaggtttctttcattatgtgtttgctgtaagactttgtacatttttgtgcatattggtatcatttggcagtagggctggaaccaaagtattactctctttacaaaattttaatttaacatgtttttaaattggaccttctttatattgtattaacagccagcattcaaaattgataaattaccaatttgaggcccaataacagtgtatttgtttttccaaaacaaatactttcttttgaatggtttcagtgagccaaccattttataaaaggcaatttttaaaaactataaatacagtattttaaactgaatgatgatatgccttccagggaaaaccttgaatttttcctttataactgacttttggattccaaagtcatttgcacattaacagagtacttaaatttacttgttcagtccataaactatgatatagcctctatacatggtaagaaaatttgaaaaattaaagatggttgcacagtatacttttataatccagcatgtaacaccacatgacaatttgttggccaaatgctggtttggagtttttttgaggaatcactttggtttttttgtcctttatatataaccttattggaagtattaattctaagcctgtctctcaagtttatttatagagaaaaagtaagtaatctgtattgccacataccttgaaaatagaatgtggtatgtttaggatgcccacggaatgaatttttccttattccaattcaaccttctgtctggttgtgccaggaaaacagatgttatatgacctatgtcatttttgccattatagtcaaatgttaaaagaagaaaaaagtctgctgaataaaaaggccttgatcaaagtttcagatggggaaaatcatacagatattttatgtgtttccaacatagattatgtggctgttggtttcttgagatgacagtgcaaaggatttgggagagagaacaaatttggggcagtagttgaaaacgttgggtcattttcctgactctagctgccaaatggccatcatatgcttttaatctttgtttcagttgtctgtcagggttgaattaagaagctactggtttattcccaattgttgatgcctttaggtatgttggaatcttttttttgcctaggaggggccagttgaaaatctgtgactcaagaggcagtgaacagaatactgttttctggggaaaaattggttggctacttgatgttaattatggcacagtaacaggaaaaggttgtgtctgtgtttttaagtttttctttattctgcttttttgctgctataagagttttctgaaatttatattttaaacttttcatgcactttactgtttctagtctcaaaatgtgatatttttaataaacaagaaattttccattatgtgaatgaaattttaaaagacaatagcctatatttgtgtctcactaatatataaagtataggtcaaatttaaattatttaattagttttaaatatacacaatttgtctcctctttcaaacctgacatcttcggctgttttattagtcttaaatgatgcatttactttggtcattttatgctaatttcttccatagtaaattaatcaggctatataaggtaatatttccccagagggtaattttagtgggacgagggtggtgggatgatgtcatatcatacatgggattgcatcagaagggttctgtaaagcctgaactcccttttaaaagtgcctagtgatagaggcgttgtttgtcatctattataattggaatgtcattgtagttcagtgaattttgatgtaaataaaatatcttttaaaaatgttaaagtaccaggataaacaaacaaaaagaaacaacccttaagatgacagattttcctcaacatgcaggtttcccttcttatatacctcaagtatccaacatctagccatgcaaattgattacctgaagcatagtactggaaagtagaatagcatgaaaaacttaattttgtggacattacctttttttgtaatcagctactgtatgttttattttagatcttttgttttgggtgggttttctgctctggaggtatatgcactaacaaaacattttcctcctttcatatacgcatgttaattagcaatgtgagcaatatttcctaccatacttcactcccaatattttttgagatgtttgtataaaatggaatttaaagttcacttatgattgtatatgaaccacagaggagcccatttattaataaaaaacttttttaatagttaaatgtagagggaaaaaataaaaaaaaatgggaaacattgtaaacagcttaagtttattttgtgtatgatcgaggcactctgttgcaggaaggtgtgtaattgggttctctctgcttcaaatgcgctctttcaaaccattcattatcctgtgtatttttaatgtggttttagtaaatgttggtagtagctctgttgaagtaggtaattgtgttatgttttgggtggtacacacttggggcatggtaacccaaatttcatgtgcacggtttccctttagcccactgcccaaatttcacatacccttcaccctttgttccctttgtaaaaggagtggtatctgttttgagctgccaattcagatgatcagaaatgctgctttcctcagcattgtcttgttaaaccgcatgccatttggaactttggcagtgagaagccaaaaggaagaggtgaatgacatatatatatatatattcaatgaaagtaaaatatatatgctcatatactttctagttatcagaatgagttaagctttatgccattgggctgctgcatattttaatcagaagataaaagaaaatctgggcatttttagaatgtgatacatgtttttttaaaactgttaaatattatttcgatatttgtctaagaaccggaatgttcttaaaatttactaaaacagtattgtttgaggaagagaaaactgtactgtttgccattattacagtcatacaagtgcatgtcaagtcacccactctctcaggcatcagtatccacctcatagctttacacattttgatggggaatattgcagcatcctcaggcctgacatctgggaaaggctcagatccacctactgctccttgctcgttgattttgttttaaaatattgtgcctggtgtcaacttttaagcaacagcactgcctaaaagcaagcagagaacagaatcccagcaccattctataggcaactttttagaattcagatatagtaaatctgttccagatttatgatgttttatgtaaaaaaaattttgtataataacatagctgaatatttttgtttcatttctttgatgtaaggcgtgtgaacattcgtttgaatatcacatgttgaagtcaggtatggcacaatgggttctgagaccagcttttcctcccctcccatttgccttgttccaagctctttcttttcaaattacttttctgatattcataggcaggtatttaattttactaattagcatcctgtgtgaatgtattaaagaagccactgtgttttagtgtagttggcaaaaatataaaagctgtttcttatttgcccctatttttttggtgtcttaaagttatatattaaatcacagagaagcaagggagaaagttgaaagatatctaaggctcatatcacttgattctatggtagattatattagaattgaggatgtggcacattaaaactggaacatgggcaaatatagtgttccattttaaaattctaagtttatattgttaaatgggtgaaaatttaagtttatatttgcatttccaagcgtttctaaaaatcactaatgccatctatacttttagtatgaaacagcagactatagaaagcacagggaagaataggctaaatacattctttgaagaaccagaggcatataaccacatcattatgtcattcctaatacatggctagattttctaatgataaaattgactgtgtcccaatgcttatttgattctaagcttttttattctgtttctgagatattttaatagctttgcaaaatatgctgaccagtttttggaaaataatggtttttatagcaagcaaagactttatggcacattttcaaaatagcactcatacatacttacattttgacagaaatgtgaattctcacattgatgagatattctttttcccacctgccctaccctttaaaaaaggtcacttttctaatgtgtagtagattcatttacgcctttccctttgagtcataccatgtttggagaactgtgtgaattgtaggtagagaaattaactagggaagccagaagcttgaactaaagttttaaatttgtaggcagatgagaacttttatactatggttgctttgggcgattctaattttgtaatagcatcatgatcaccaaaattaattcaaacattttagtacatctttaatctgtcttatttaccaaagttctaatctgtttaagaacaggatgccaagagcatctttcattttatagaatgatatgctcacctttataagtgtcacctaaaagcttgagggtaaaaaagaagcagcccatatatctaaactacaggatgtcttgaacaagattcacagaaagaaagaaaaaaaagcagttctttccaggaaggtggtaaggaagagcatgcatatttcttgttttaaccaaataccttttttatgtaaatgtctctattaaaccccaggtcctacaccaggaaatagggtgataaccaggaaaataccaagctttaacccagttggcagttccttgtggcatacatttggttagacttgggtttttcctggaaccaaaggaaaataagcatgttgagttcttcgttcaacagacatgacattgaagtaatagaatattttttaagtaaaatagttttcactttcaaagcctatgacataaggacatttgtgcttattaattgttaatttttttttatggtacattgtataaactgagtagcattgaactgcattttagaagtatgtcatcagaaacaaatcacattatggaaaggatatacaaatgccaagtgatatgactcttttggcatggtggtagcatggtccattcagctttcagaatctttcggaggctctagtttggtgcctagtactagttatttttgttagaacaatctctcaaaatttagataattttccagttgtatgtctgtcacttttaactctaaagcgtaagaatcatggtaaccctctcagaagtggtcctttcttgctcatttcagtttcgtattaacttcaaatcactgatgtattgtctttcaagctatcaattgttatatgtaccaatttaatttagtttgtagttatctgaagtcacaaaattggttcagcattgatgtcaaacaatggctttgcttcttaccaaacagacttagtatcctgctgcttgtttcaatcttgatgcagtaagtgatgcagtatctgggtctgtatttacttagaaactgtactgtcctttctctgtgcttaacttgctaaaaatatattcccttacctgtgaaattcctgagcggtgctctgccaacttttcaaggggagggatttggatggctgtgttactgcacactggatctggaattgttcagggttatgagtgacaaatttcttaaacaccagcagcactgagatgtgcactatgggcattcgtacagttgttgtccaaatgcaaacaactttttcatcttggagaagctgagatacagagttcaatagaactacttggaatattttgagaaggttgaatgtttcatctttggctttgttgtctctggagtggggaagtatggagggctttttttttttttttttttttttttttttttttttttaaagagagtgtgtatgtactttttctctctataagggccagggtgttggtcaaattcaccatcgattaatttatatcttctgttgtgatttttttcaactatataacaagtgccaactaattgtccatgggacaatctacttttccactcaatttatcgttttgagtagggaaaggttcatttattttcattacctggcattaagttaaagaattcattattttgcatacatttgagtcattctgtgacctataaagtgtttttgtaactatctaattctaatggttgcaaagcaaagcacatgactgtaaaaccaagcaaggtgttttagtaactttttccctgaatacttggtagtttccattgatactattccaaaacaaattctgctgttttaggttgtatatttactttgcttttgttctaagaaaaagccaaggactaaatcaacttgtttttgtgtttcagtaatcagtttaaaatctaagatttttttttaaattagactatttaatgaagtgccatgtaattgtagcttgctagtgtttaatgtttaatagactggttctgtaggtgttttaaccatttaacactctctgccatccctggagaaagtggttctactcttactgaacacattctctctgacaaaatcaccagctgctttatttttctatttattacagttaaacagttgatgaggtctgaatcttgaccaaaactgctcagctgagatgtttttcacaatagacactgtacaaagtgtgcgtgcaaaaggacacggttggtagtattttttcattaatgtgaacattgactaaaaaaaagcagtcctgccttttaaatcttgtggcagctcagaagggaggtgcttaagaaccttaactactatgtcagataacaaaatatttttttccattttggagattggttactgctcacacatgatgtatagggctaaatatatgcttgtttccttgcacctgtgtacttcccctctctccctccctttccttcccctgtaggcaataaatggccattttgcaactgca

SEQ ID NO: 3846 - DNA, 2774 bp, Homo sapiens
caatctgaggagcaggaggaccggggcgccggtgtcctgccgcctccttctccttgctctcacctgcgcctattagtccacgcgccttcaaggccaggggctacagcccagacagagaggggacagcagagggagagagagcacctgaggatacagagctggcactggactgccttttcaccccccaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgacatctacgagaacctggacctccggcagagacgggcctccagcccggggtacatagactcccccacctacagccggcagggcatgtcccccaccttctcccgctcacctcaccactactaccgctctggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatggggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccctaaa

SEQ ID NO: 3847 - DNA, 578 bp, Homo sapiens
gttgctcaaaccgagttctggagaacgccatcagctcgctgcttaaactggaaacaaaagtctcaacttccaacctctttgcagctaggagtggccaagtagcatagatctggtgaatgaactgcaggtgggaatttctgagaaggtttccttcttaaatagaaagattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacat

SEQ ID NO: 3848 - DNA, 1405 bp, Homo sapiens
ggaggtaccggctcaggcttgggatcccggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccgctggtgctcaggaagcccctatcaagaagaagcgcccccctgtgaaggacgaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagcctttcccaggaactcttttttatgccagaacgcttcctctcccctgctgtctctggggctgccaccctcccccacagtccaggcccttcagccaagggctctgcaccagcaccttggaagcaccaa

SEQ ID NO: 3849 - DNA, 594 bp, Homo sapiens
catttcgtcttagccacgcagaagtcgcgtgtctagttctggtcctccccgctttgcagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggct

SEQ ID NO: 3850 - DNA, 594 bp, Homo sapiens
gcagttcttgagttccacatgcagagcagatgcgacagctagaagtgagtagggcccagaccctggcccaggaagatccactaaaggaggccatccttccgccttcttctgcaggagtcagggggcgtgtaaaggtgatttgttcgccaagaaaagcacttttagtaaagcacagatgttaatctagatcatggaaaagtgccacacactagatttagcacataagcaaggagtctctagaacactcagaagaaaatgaatgaatccatgaatgaatggacaagtgagagcccagagcagctgaagccatgaagtgctttggaaagagaagcgtgcctgggaaaagagagtggctgagtgctaagagcagggtgaacaccatggaaaacttgaaattgaaaacatcacaattttaatgagaaaaagcgcaacccaaagtgaagagcaccattataacaaaggcgatgcaaaccagtaatgcagaatcctattgctctataaaaatttgaattgcttgaatctattacaaatttttgccagtgtgcttcctgcctcaaggatggatggaaaggcagatgtaaagtccctcatggc

SEQ ID NO: 3851 - DNA, 1258 bp, Homo sapiens
agccgtggtcgcgctgtgtgtgtgtgtgagtggagagtgagtgcgggacctgaggctgtgtgtgtgtgaactgtggccactggcggggtcgggggggggcagcggcggagccgcctcggacggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgtagtggatggagaccaagaggaagcttctggagacatggagatctcctttcatcttgattcaggccacaagactagtagcagagtgaactcaacaaccaaacctgaggatggaggattaaagaaaaacaagtcagcaaaacagggtgacagagagaactttaggaaagccaagcaaaagttgggtttctcatcttctgatccagatcgcatgtttgttgagctgtctaatagcagttggtcagaaatgtctccctgggtgattggcaccaattataccctttatcctatgactcctgctatcgagcagcgactcattctccaatatttgacccctctaggagaatatcaggagctacttcccatattcatgcaacttggatcacgggagctgatgatgttctatattgacctgaagcaaactaatgatgtcctgcttacatttgaggcactaaag

SEQ ID NO: 3852 - DNA, 1549 bp, Homo sapiens
gtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtggttttacctcggatagagacatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgact

SEQ ID NO: 3853 - DNA, 1785 bp, Homo sapiens
tcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggtgagcggcggccggcgggcgggagctctggcgggagccgcgccggcctgacgcgctgtcgccgctggttgcaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaa

SEQ ID NO: 3854 - DNA, 2486 bp, Homo sapiens
gttgctggctttttcaggagctgctcgctcgcagccagagacgctgctttttttttccgggttcggagccgttccggatgctttaggctgccggatgtctgatctccgaataactgaggcgtttctgtacatggattatctgtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggttttagtattaaagcagtgccattccagaatgccatcttgaatgtaaaagaacttggaggggctgataacatccggaaatactggagccgctactaccaaggatctcaaggggtaatatttgtattagacagtgcctcttcagaggatgatttagaagctgctagaaatgagctgcactcagctcttcagcatccacagttatgcactttaccctttttaatattggccaatcatcaagacaagccagcagctcgctcagtacaagagatcaaaaaatattttgaacttgaaccacttgcacgtggaaaacgctggattctacagccctgctcactggatgacatggatgcactgaaagacagcttctctcagctgattaatttgttagaagaaaaagaccatgaagctgtaagaatgtgaaatctggcaaagaaaacaggctcccaaaaggccttgaacctatcatgttagtttctcattttaattttattttggtatcaagactatattggcttcagtatctattttcctctggtcatttcagactctcatctctctattaaagtgaatattctgtagatcagatgaattatcatcggcattaacgtcaagtacacactactgagagagaatttattctctgtttaccactaattatcttccccgcatgtctcttccttctgttgttctaagcatctcttctatactctgtgctgaaacggatggaattcatggcttatggaaatcaaatcccttttgaaggactcagaaagactcacaagaccttgatcattttctctgggtttgggagtggagtattatgtgactgggactccacaaaatatttatattattttcaagacctattgggggttttgttttattttatctaatttttttttttttttggtatactgagcttatagactatgagagaaaagtgagcaccaaaaacttcattaatcaccttatcaggaaggaatatcctgccatagtaaaattggctctgaagagcttagaggcaagttacacaatgttttcttgattacatctgaagtctcttctcttttaagagcaaagacattgtttcagtttctgagagtggttagaggaaatttaggtacaatgcatgcatcacagactgtatttgattgattcgagtcttcaaatattgtttaatggaatgatgagcctgcataaagtgaagctgcaatgtaacataggtatctttttctaaaaacttcaagtgtttgattaaaatagagaaaataatttttaaaataatagataaaaattttaaaaacagccagaaaaagtataatttatactggttagggtttaagatggcatggatttgacaaagataacaaagacagaatcatctatatattcattcattacgtgttactgtagtttattggaatctgttaatgccttcctctagtagttaaaggtttatcagtatttctattataaacctctattttcaggggtttcaatgtgcccttaaaattgtgctggggctgcagcaaataaataatattgggactcatattcagtctttggaactagttttttttccatttaatttaaatgacaaaattgcatagggataaatgtacagttttactaaggtttagcacctttgatcttttctaaatcaggaaaaaaatctatgcatattgaggttcacagatgaaatattctttggcatactttgtagactttgaccacttaaaatactaagtggccaaatgataaaaaaaactgctccctgcacatgagtgtaaaaacatgtttgtaattttaagtaaaatggactgatacccaaataccacagactcacactatattacagaatgatgtaatacctggtaattctccagaagatagacttcagacccttaatgccatttaaatgtagtttttgtggtttaatcttatgagtagattgtaatgaaatcattacctttgaaacatcaaacacttctttaagctttttttttttaatgtcatgaatcaggaaggatacatagtgattcgtatacaattttgtctgcagcattcttgaatatttttaacactgtgtaatccctgagcagcacaaaacttttattccgatgaccagttacacaattcctgtttttattttgtcctgttgtgctcatcttctatgaaaaataaatgattattaggc

SEQ ID NO: 3855 - DNA, 6652 bp, Homo sapiens
taatgacgtcacgttgtttcgcgggagaaattcgaaagtggattttgtgcaatttgacaggtggtataaatagttgaatatttcctattttctggacccagctggtttataacttcagaagaaataatggaaagccaagaatttattgttctatatactcatcaaaagatgaagaagtcaaaagtgtggcaagatggaattctgaagatcactcacttaggaaacaaagcaattttatatgatgacaaaggagcatgtttggagagtctgtttcttaaatgccttgaggtgaaacctggagatgacttagaaagtgatcgatacttaatcacagttgaagaggttaaagttgctggagccataggtattgttaagcagaatgtcaataaagaagcaccagagttaaattcaaggacatttatatcctctggccgatctcttggatgtcagccctctggcttaaaaaggaagtttactggttttcaaggaccacgtcaggttccaaagaaaatggttattatggaaagtggtgaatcagctgcatcacatgaggctaagaaaactggccctactattttttctccattctgcagcatgcctcctttgtttcctactgttggcaagaaagatgtaaataatatactggcagaccctgagaacattgtgacttacaagaacagggagagaaatgccatggatttttcttcggttttttctccatccttccagattaacccagaagtgctgtgtgaagaaaattatttttgctcacctgtcaattctggaaataagctttcagactctttactgaccaatgagcctgtgaaaagagatagtttggcatctcactattcaggagtttcacaaaacatcagaagcaaagcacagatattagctcttctgaagtccgaatcatctagttcatgtgaggaactaaattctgagatgacagagcattttcctcaaaaacaaccacaaggaagtttaaaaattgctactaaaccaaagtacctaattcaacaggaagagtgtgctgagatgaagagcacagaaaatttatactaccagcatcaatcagaaaataccatgagaaataaaagccggtgggccatgtatttatcctcacagagttcacctatacattcttctactgtagatgggaatgatacagaaaggaaacccaaggcccaggaagatgatgtaaattctaatttgaaagacctttcattacaaaaaattatacagttcgttgaaacgtatgctgaagagaggaaaaagtataatgtagaccagtcagtcggtaataatgatccatcctggaatcaggaagtaaaattagaaattccttcattcaatgaaagcagtagcttacaggttacttgtagcagtgcagaaaatgatggtatattatcagaatctgacattcaagaagataataaaataccttttaatcaaaatgacaaggggtgcattaaaggatcagttctcattaaagaaaatgctcaggaggtaaatacatgtggaacactggaaaaggagtatgaacaatcagagtcatctctgccagaactgaaacatctccaaattgaatctagtaataattctaggatctctgatgacattacagacatgatttctgaaagtaaaatggataatgaaagtcttaatagtattcatgaatctctgagtaatgtaacacaaccatttttggaggtaacttttaatctgaacaattttgagaccagtgacactgaggaggaatcacaggaaagcaacaaaatttcccaggattcagagagttgggtaaaggacattttggttaatgatggcaattcatgttttcaaaagaggtctgagaatacaaactgtgaagagattgagggtgaacatttgccattcttaacatctgttagtgacaaacctacagtgacatttcctgttaaagagactctgccatcacagttttgtgataaaacttatgtgggttttgacatgggaatatgtaaaactgaaaacacaggaaaagaaatagaggagtatagtgacacattaagcaattttgaatctttcaagtggactgatgctgtatacggagataataaagaagatgctaataaacctattcaagaagtcagaattaactatgattttgctttacccccgaataaatctaaaggtataaacatgaatttacatattcctcatattcaaaaccagattgctgaaaacagtaatctattttcagaagatgctcaacctcagccttttattttgggaagtgacttagacaaaaatgatgaacatgttttaccctcaacttctagtagtgacaacagtgtccaactattaaataccaatcagaatcactatgaatgtattgcacttgataaatcaaatacccacatttccaattctttgttttacccactgggaaaaaagcatcttatttccaaagacacagaagcacatatatctgaacctgaagatttgggaaagattagaagtccaccccctgaccatgttgaggttgaaactgccagagaaggcaaacaatactggaatcctagaaattcttcagaactttctggattagtaaataccatttctattttaaagtcgctatgtgaacacagtactgctttagacagcttggaaatattgaaaaagaaaaatactgtctttcagcaaggaactcaacagacgtatgagccagatagccctcctgaagtgaggaaaccatttattacagtagtttcaccaaagtctcctcatctgcacaaggattctcaacagatactaaaagaagatgaagttgaactaagtgaaccacttcagtctgtgcagttctcttcctcgggaagtaaagaagagactgcttttcaagctgttattcctaaacaaatagagagaaaaacctgtgaccctaagcctgttgagtttcaaggacatcaagtaaaaggatcagctactagtggtgtaatggtcagaggacacagctcacagctaggatgcagtcagtttccagatagcactgagtatgaaaactttatgacagagacaccagagttacctagcacgtgtatgcagattgacttcttgcaggtgacatcaccagaagaaaacatctctacattgagccctgtttctaccttttctttgaactcaagagatgaagacttcatggtagaattctctgagacgtccctgaaagcaagaactttacctgatgatcttcattttctcaacttggaggggatgaaaaaatcccgttctctggagaatgagaaccttcaaaggctttcattattaagtagaacccaggttccacttattactttgccacgtactgatgggccacctgacttagactctcattcgtatatgatcaactctaacacatacgagtcttctggctcccccatgctcaatttgtgtgaaaagtcagcagttctttcgtttagcattgagcctgaggaccaaaatgaaacctttttctctgaagaatctagggaagtgaatccaggggatgtttcacttaataatatatctactcagagcaagtggctgaaatatcaaaacacatcccaatgcaacgtggctactccaaacagagttgataagagaataactgatggcttctttgctgaggctgtttctgggatgcattttagagacacaagtgaaagacagagtgatgctgtcaatgaaagctctttagactctgtgcatttgcaaatgataaaaggcatgctctatcaacagcggcaggattttagcagtcaagattcggtttccagaaagaaagtactttctctgaatttaaagcagacttctaagacagaggaaattaaaaatgtattaggagggtctacctgctacaactacagtgtaaaggatttacaggagataagtggctctgagctgtgctttccaagtgggcagaaaataaaatctgcttatcttccccaaaggcaaattcacataccagctgtttttcagtctcctgctcattataagcagactttcacatcttgcctcatagaacatctaaatatattgctgtttgggttagcacaaaacctgcagaaagctctttcaaaagttgacatatcattttatacatcattgaagggagagaaactgaaaaacgcagaaaataatgtaccatcctgccatcatagtcaacctgcaaaacttgtcatggttaaaaaggaaggtccaaataagggtcgtctcttttatacatgtgatggacccaaagctgatcgatgtaaattctttaaatggcttgaggacgtgactccaggatattcaacacaggaaggagctcgacctggcatggttttaagtgatattaagagtattggcttatatttaagaagtcaaaagataccactttatgaggaatgccagcttttggtgagaaaaggatttgattttcagagaaaacagtatggcaaactaaagaagtttactactgtaaatcctgagttttataatgaaccaaaaaccaaactttatcttaagctaagtcggaaggaaagatcttcagcttatagcaaaaatgatctttgggtggtttcaaaaaccctagactttgagctggatacttttatcgcatgtagtgctttctttggaccatcatctatcaatgagatagaaatactgcctttgaaaggctatttcccttctaattggcccactaacatggttgtccatgcgttattggtttgtaatgctagcacagaactgactactttgaaaaacattcaggactactttaatccagctactctacctctaacacagtacctgttaacaacgtcttcgccaactatagttagtaacaaaagagtcagtaagagaaaatttatcccaccagccttcacaaatgtcagtacaaaatttgaactactcagcctaggagcaacattgaagttagctagtgagttgattcaggtacacaagttaaacaaggatcaagctacagctctaattcaaatagctcaaatgatggcatcacatgaaagcattgaagaagtgaaggaactgcaaactcataccttccctatcacaatcatacatggtgtgtttggagcaggaaagagttacttgctggcagtggtgattttgttctttgtacagctgtttgaaaagagtgaagctcccaccattggaaatgcaaggccgtggaaacttctgatttcttcttctactaatgtggctgttgacagagtacttcttgggcttctcagtcttggatttgaaaactttatcagagttgggagtgttaggaagattgccaaaccaattttaccttatagcttgcatgctggctcagaaaatgaaagtgaacagttaaaagaactacatgcactaatgaaagaagacctgactcctacggaaagagtctatgtgagaaaaagcattgagcagcataaactggggaccaatagaaccctgctgaagcaggttcgagtagttggagttacctgtgcagcctgcccattcccatgcatgaatgatcttaaatttcctgtagttgtgctggatgagtgtagtcagataactgaaccggcctctctccttcccattgcaaggtttgagtgtgaaaagctgattcttgttggggatcccaaacagctacctcctactattcagggttctgatgcagctcatgaaaatggattggaacaaactctttttgatcgactttgcttaatgggtcacaagccaattctattgagaactcaataccgttgtcatcctgcaatcagtgctattgctaatgatctgttttacaaaggagccctcatgaatggtgtaacagaaatagagcggagccctttattggaatggctaccaaccctgtgtttttataatgttaaaggactagaacagatagaaagagataacagctttcataatgtggcagaagctacgtttacactcaagctgattcaatcactgattgcaagtggaatagcaggctctatgattggtgtgataacattatacaaatcccagatgtacaagctttgtcatttactcagtgctgtggactttcaccatcctgatattaaaactgtgcaggtgtccacagtagatgcttttcagggagctgaaaaggagatcattattctgtcctgtgtaaggacaagacaagtaggattcattgattcagaaaaaagaatgaatgttgcattgactagaggaaagaggcatttgttgattgtgggaaatttagcctgtttgaggaaaaatcaactttggggacgagtgatccaacactgcgaaggaagggaagatggattgcaacatgcaaaccagtatgaaccacagctgaaccatctccttaaagattattttgaaaaacaagtggaagaaaaacagaagaaaaagagtgaaaaagagaaatctaaagataaatctcattcataaaaagacatggtgtaaatattttgtatttatgtaaattcagactcattttacatgatatattttttatatttttattactctaaaccctcttattaaaaatatgatatttaaataacatagtaaacacatgtaaaaattttgttcttcaaaaaagtgtacaaaaggtagtataaaatcctactaataaaaataagcttttttctaagaagaa

SEQ ID NO: 3856 - DNA, 1304 bp, Homo sapiens
gtggaatgtgaggggaggtggaggagatggcggcgacggcccgggaagatggcgccagcggtcaagagcgaggtcagcggggctgcgagcactatgacagaggatgtctcctaaaggcaccttgctgtgacaagctttatacttgccgcttgtgtcatgataacaatgaagatcatcaactagatcgctttaaagtgaaggaagtgcagtgcataaactgtgaaaaaattcaacatgcccaacagacttgtgaagaatgtagcacattgtttggagaatattattgcgatatatgccatttgtttgacaaagataagaagcagtatcactgtgaaaactgtggaatttgtaggattggtccaaaggaagattttttccattgtttgaaatgtaacttatgcctagctatgaatcttcaaggaagacacaagtgtattgaaaatgtgtcccgacagaattgtccaatatgtttggaggacattcacacatcccgtgttgttgctcatgtcttgccatgtggacatcttttacatagaacgtgttatgaagaaatgttgaaagaatatgaccaggtattggagacagctggatgatgaagtagcacagactcctatgccatcagaatatcagaacatgactgtggatattctctgcaatgactgtaatggacgatccactgttcagtttcatatattaggcatgaaatgtaagatttgtgaatcctataatactgctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagcataaaatcatattacaagtacgtaaggattcagggtctcttgatagacttatcatagctctatattgaatgaaagccactgtgcttgtgttttgattggaaattcctttagtgtcagttttttggaagccaatgatgtttgccactgatacattcatagaagtgtattatattttcatgaagctttgctttaagtgacactacgcgtgcagttcatttctagttcttgatagaactgcacttaattttcagtagtagtcttgactttttaagggctgtgttatattaagttctcccttactgttaaaacctaattaaatatgctttagaattttctaagacagtcctctggatcctctaaatgtgaattttgatgtaataactgctaataaaattatattgaaac

SEQ ID NO: 3857 - DNA, 600 bp, Homo sapiens
attcgctatagattccttgtttctcacttcgtagcacgagccactctgaccatcaagatcagaaaaacttctcagctgcaagttagaagtggactggccattgaggaggctctcagcggagtcgctcttcacaggagtcttgaacgcggtgtggaatcggcagcgaggaatcctggagcacagagaagctcccagctttgaaggtcttgcggtggtgaaaaattagacgatttcaagaattggagctgaatctgatgttaagtaatggcaacaggtgacttaaaaagaagcttacggaacctagaacaggtgctccgcttgctaaattatcctgaagaggtggactgtgtaggtttgataaagggagacccagcagcatctttgcccatcatcagctattcttttacctcatactcaccttatgtaacagaacttataatggaatccaatgtagagctcatagcaaaaaatgacttgcgctttatagatgctgtctataagcttcttcgtgatcaatttaattataaaccaattttgacaaaaaagcagtttatccaatgtgggtttgcagaatggaaaatccaaattgtttgtgatatt

SEQ ID NO: 3858 - DNA, 713 bp, Homo sapiens
aacagccagaggccactggtgtataggatcctcctactctctgactttttttcttgtagttattttgaggccctgtcccgtggagagacgcctccggtgagagagcggtctgagcgagtcgctttgtgtaactgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccacaatggtgggttgccccgaatcccattcagcaccttccagtttctctacacgtatattgccgaagtggatggggagatctgtgcatcacatgtcagcaggatgctaaactacattgaacaggaagtaattggtcctgatggtttaatcacggtgaatgactttacccaaaaccccagggtttggctggagtaacagcacaattttggcaattttaaaggaagatacagaggtgattgtacttcagaatgataaacccatataccacctaaaatcaattttcttgtacaactggtacacactaataaacaaacatgtgagatcag

SEQ ID NO: 3859 - DNA, 2789 bp, Homo sapiens
agaaagctccgcagttcttgagttccacatgcagagcagatgcgacagctagaagtgagtagggcccagaccctggcccaggaagatccactaaaggaggccatccttccgccttcttctgcaggagtcaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagccctgtcaatgaagacaatcaagatggtgtcacgcactctgatggtgctggaaatctagatgaggaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggctccacactacaggttcaagagaagagtaatacgtggtcctgggggattttgaagatgttaaagggaaaagatgacagaaagaaaagtatacgagagaaacctaaagtctctgactcagacaataatgaaggttcatctttccctgctcctcctaaacaattggacatgggagatgaagtttacgatgatgtggatacctctgatttccctgtttcatcagcagagatgagtcaaggaactaatgttggaaaagctaagacagaagaaaaggaccttaagaagctaaaaaagcaggaaaaagaagaaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactagcactcaactttggtcattctgctgtgttcattaggtgccaatgtgaagtctggattttaattggcatgttattgggtatcaagaaaattaatgcacaaaaccacttattatcatttgttatgaaatcccaattatctttac

SEQ ID NO: 3860 - DNA, 1091 bp, Homo sapiens
gagccgatgcccgattccgcgcccgccatggccgacaaaatggacatgtctctggacgacatcattaaactgaaccggagccagcgaggcggccggggcgggggccggggccgcggccgggccggctcccagggcggccgcggcggtggggcgcaggccgccgcgcgagtgaatcgaggcggcgggcccatccggaaccggccggccatcgcccgcggcgcggccggcggaggcggcaggaaccgaccggcgccctacagcaggccaaaacaacttcccgacaagtggcagcacgatcttttcgacagtggcttcggcggtggtgccggcgtggagacaggtgggaaactgctggtgtccaatctggattttggagtctcagacgccgatattcaggaactctttgctgaatttggaacgctgaagaaggcggctgtgcactatgatcgctctggtcgcagcttaggaacagcagacgtgcactttgagcggaaggcagatgccctgaaggccatgaagcagtacaacggcgtccctctggatggccgccccatgaacattcagcttgtcacgtcacagattgacgcacagcggaggcctgcacagagcgtaaacagaggtggcatgactagaaaccgtggcgctggaggttttggtggtggtggaggcacccggagaggcacccgcggaggcgcccgtggaagaggcagaggtgccggcaggaattcaaagcagcagctttcggcagaggagctggatgcccagctggacgcctataatgcgagaatggacaccagttaaacagaccagcaaatccgcgtgcggaacaggacccaggcgtctcctcttgctccctggttggggggcggtggctggggctgtgcggccaatgatggatttgtttcttttatgttttaaaataggatttaaaaactcatgtaaaggttttttttttttctttttttttttttttaattctgaaacagacctgttttgtaccgagttatttttgggataaattttactggttgctgttgtggagaaggtggcgtttccaccttttccataataaaatagaaatgtgtgtagaa

SEQ ID NO: 3861 - DNA, 498 bp, Homo sapiens
gttgtagcagagcctagctaattacccttcataattagaattgtcctatctactacggagtgttatagaccctctttccacaggaggggaagaaagaaagaagccggaatccccctgccatcctatgtctttgcattattgcctcactaccacatatgatcttcagaagaaaacctgaacctgctgacatggccaagcatggagccgacgagccatcctccaggtcagggagtccggacagggaaggtagggcctctgaggacagatcgctgcttcatcagaggctggctgtccgggagctcatcgacactgaggtctcctacttgcacatgctccagctctgtgcctctgacatcaggagccgcctccagcagttgccgcagggagatctggatgtcctgttctcaaacattgatgatatcatcaaagtgaacagcagattcctccatgatctgcaggagacagcctccaaggaagaggaacaagtgcagctagttg

SEQ ID NO: 3862 - DNA, 1155 bp, Homo sapiens
acgcctggtgaatggacgcactcttaccaattctgctctgggagatgcagcggtaacctaccgagcgcagaggccggcgcgcacccgtggagcccgcgctcgcgatccctcctcgtgccagggccccagggcagtcaaggcctgccgaccgttaggcgggtcaaggggtacacagggtgcgaattcgttaggcaaaagctgggtacaggcgcgagccacaggcacggaaacctcgcgccgaccggggccctaggcccgacgacggcaggtaaggggaagtggaggcacacagggctgggacgtgccccaggcaccatacgggtggcttcgggcgcgggacgtccgcagccccgcagctcccaggacgttcgacaatctgcagctgaccagcttcggccggtttggggataaagggaagacaggcggcgcggggagtgggaacgcctgaaggccgcgcccctcctttcaggtcggccaggagcgcgccgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacaga

SEQ ID NO: 3863 - DNA, 1244 bp, Homo sapiens
ctgtggctctgtggtaggggaatgccaccaactccctgaggagcagccgtgtggtatgattggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaacagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 3864 - DNA, 3305 bp, Homo sapiens
gtggcgggggcgtggccatggcgggggcgctccggcgggggcgggccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagcccggcccaccatggacccctctgcccacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcgga

SEQ ID NO: 3865 - DNA, 2044 bp, Homo sapiens
gtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggaaagaggttggcctcagcagcaatgagggataattctttcaagaaaggaatgaagagagaagttagatggaaaagagatttttaaggtcaaaagaagcagctgaagaacatgtgtaggacagccttaggagttactacacttcaagacctgggtgtctgctggaggaaggaacatgaccctgcggagatgttaagggttgggagagctgagcttggaggctggaagcccagctgggaggctattgttaaagaggttgctgcagcaactggtcacacagtagtgttggtagaccagacagaggacatcctggcaaaatccaaaaagggaattgaggaaagccttaggaaagtggcaaagaagaagtttgcagaaaaccttaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggcagaa

SEQ ID NO: 3866 - DNA, 2302 bp, Homo sapiens
aaggatctgcttagaaaccaaagctccagccgagtgtttcttttcccctacatttttagtgattcccttctgttgatgcctttgaaagctcggagaaataaatacgtttattgttatgctgttagaaaacaagttcatgcttgtcctctaaagataagtggtcttttcattctactttttgttttgtagtaagagccataaaatttgcaatcgcaagtttatgttgttatacttagttacccaaggggtagttttaagcatttttattcatatgaatatttgaatataaatgtgtgttcaaatatatagaatcgttcttatattccacatttttaatatttaaactattcacaatatcttttaatgatgtttaaagaacggcagtgtagagatactgttgtcagatttgtgaggtgagcacacgttgatattgccagtttcgcttttgtttatcaattcaataagcactgctttttaaaacacgtgttgaagcttcaggtttgcacagaagttcattttcaggaattcctaactaataaagggtatcagacacgttcttacagttttgaacataaatactgcagttagcatatgtagtgggatatttgtgtggtgaaagtgcctccatatttcatatcttttctttgaaacaagattctgttcagtatgcattaagtggtagttattttttaacttcctgttacatacgtaaatttcataaggaaaggaaatttggggagtcgttacagcttttctccctttaatcacagcgtacctgtccattgctcacattgttttcagaaaaaaaagttgtatctcagctggatatctgacttgactttagtaatgggcctagaaactataaactgaacaaagcttataatgcacaaaaacaggataagtacatttgggggacaatatcttactggcaagtaactggagtttcaccaggcgtgtagcaggtgggatcaattttctaaaacggaagatgatctaagatgcatattttataggcgttctcctaagcagtgctaattctacatgttttaattgctggtagatgcgtttccagaacgaggatgccatttacagcgagtgttaaaaaaaacgttggatgatgaaatacacattgcagaaaaaggatgaagttgaccagtgaaaagttgcccaagaaccccttttatgcctctgtatctcagtatgctgctaaaaaccaaaaatttttccagtggaaaaaggaaaagactgattacacccatgctaatttggtggataaggcattgcagctcttgaaggaaagaatactgaaaggagacactctggcatatttcctacgaggtcaactatattttgaagagggatggtatgaagaagcattagaacagtttgaagaaatcaaggagaaagaccatcaagcaacttaccagctaggagtgatgtactatgatgggctggggaccactctagacgctgagaaaggggtggactatatgaagaaaattcttgattctccatgtcccaaagcaagacacttaaaatttgcagctgcttacaacctcggaagagcttattatgaaggaaaaggtgttaaacgatcaaatgaggaagctgaaagactgtggcttatcgcagcagacaatggaaatcccaaagctagtgtgaaggctcaaagtatgctcgggctgtattactcaaccaaggagcccaaggagttagaaaaggcattttactggcattccgaagcatgtggcaatgggaatctggagtcccagggtgcacttgggctcatgtacttgtatggacaaggcatccggcaggatacggaagctgccctgcagtgcttaagagaagcagcagaacgcggaaacgtctatgctcaagggaatctcgtggagtattactataagatgaaattttttacaaagtgtgttgcattttccaaaaggatcgctgactatgatgaggttcacgacatccccatgatcgcccaggtcacagactgtctcccggagttcatcggcagaggcatggcaatggcatccttctaccacgcaaggtgtcttcagcttggcttgggcatcaccagggatgaaacaaccgctaaacactattattctaaagcttgtcgtctgaatcccgcattggcagatgaacttcactccttacttattcgtcaaagaatttagaccacaatgtatttcaacaaagatcatcaatgctaacacctcacaatgtgtgtatttttacagtagctatgtttggttattttgcacatcacaaattacactatcctgggtatttt

SEQ ID NO: 3867 - DNA, 1945 bp, Homo sapiens
ctctcgtggagtccgagcagctgcttcagggaggcccgggagcccctagggcgggcagccccggagcctgcagctgcgacgcagactcggaaactacaactgcgcgtgaagccgactaaagttaacgcctgtgtgattgagtcagaagctccttcaggaacacaggagtggggccgactcctggaatccggccccgggtcgcttataaatgcgccaagaaaaaaacgtcacccagtaattttttttctcatatgtagatacaaaaggatattcttaaaatttttatagagacagggtcttgctgtgttacccaggctggtctcacactcctggcctcaagtgaccctcctgtctcagcctcccaaagtgctaggattataggcgtgaaccaccacgcccagctggttcctgaggaagtcagtgtgggaatactttttttttttttatacggagtctcgctctgtcacccaggctggagtgcagtggcacgatctcggctcactgcaagctccatctcccaggttcacgccattctcccgcctcaacctcccgagtagctgggactacaggtacccaccaccacgcccagctaattttgtttgtgtatttttagtagagacgggatttcactgtgttagccaggatggtctggatctcctgaccttgtgatctgcctggctcagcctcccaaagtgctgggattacaggcatgagccaccatgcccagcccactgtgggaatacttgtgttgagcacttgctgtgtgttctgaataggacaaccagggtccaccccttctctctgggcttgttgagaagaggggtgcccagcctgacagtgatgggacagggaggcttcagtgccatttggccatgtgagcagtgttagtctgaggtacacatcatattgcctacagccttctttcctgtgtgtctgttaacatttccaaacctacactccgtgacatccagcctcacagcttacatcacagcttaatgtcctggcatttaagagacccagcgttctgttttccccgcagtaagctgcacatagtcatagcgaatttgggaaagatggaaggaatcatccagcctcgcggttcagagcccagctctgccactgtcagccatgcaagcctcagttttcccatctgtaacatggggagaacagcactgctcagcccagagggccactgcagagattctgagagagaacgtaggaagcgctgctcggcacgacctgcacacggggaggcctggcgctgcagcgggcaccctcatcaccatagggaaggcccagctgcctccggggaggcccgttctcctaggcagggtgttggaaaggggttggcctctctgctgctttctgggagagccaaggccacccctctggggtactgacagggcatgccttgtctccagtggttccccaggtggggccctgccctaccctctcctctgacctccactcactcatccctttggcccacaggtacatgtggggggcagcctggccgtccttggggggaagctgtacgtctctgggggatacgacaatacatttgaactctcggacgtggtagaggcctatgacccagagactcgcgcgtggagcgtggtggggcggctcccagaacccaccttctggcatggcagtgtcagcatcttccgccagttcatgccccagaccttctcgggtgggcgtggcttcgagttggacagtggcagcgatgacatggacccaggccgaccccggccgccgcgggaccccgatgagctgcactagccccagtctggcccggcacgggcctcggtgcaggtaactggcacctctgcggggcagtgccccactcctttgtgcacaaggacacgttgggctcacaggaggagcacaggctcttgggtggcgaagccagcccaggatccattacctggaaggtttctgt

SEQ ID NO: 3868 - DNA, 1401 bp, Homo sapiens
ctgtggctctgtggtaggggaatgccaccaactccctgaggagcagccgtgtggtatgattggtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaacagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 3869 - DNA, 4569 bp, Homo sapiens
ggccggggcaggggcctctggctcccgacactggccgagaggtgggttccggggcgggtcgctgctccttgaagccgggcggggacgcgctgcccccgccctgcctccctgtggtccacaccccctttgggctccggagccgctgggcaggaatagtccggggtgcgcgcgagcaggcgctgccaaccccacttctgcccgggattccaatctgaggagcaggaggaccggggcgccggtgtcctgccgcctccttctccttgctctcacctgcgcctattagtccacgcgccttcaaggccaggggctacagcccagacagagaggggacagcagagggagagagagcacctgaggatacagagctggcactggactgccttttcaccccccaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgctaaagtggataatgagatccttaattacaaagacctggcggctctccccaaggttaagtctatctacgaggtacaacgccccgacctcatttcctatgagcctcattccagatacatgtccgacgagatgctggagagatgtggctatggagagtcgctgggaacattatctccctactcccaggacatctacgagaacctggacctccggcagagacgggcctccagcccggggtacatagactcccccacctacagccggcagggcatgtcccccaccttctcccgctcacctcaccactactaccgctctgggcccgagagtggccggagctctccataccatagccagttagatgtgaggtcctccactccaacctcttaccaggctcccaagcactttcacatcccagctggagacagtaacatctaccggaaacccccgatctacaaacggcatggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtgtaatgggacacactgcctgccatgagacttgcttttctgtactgtcaggcaagcccacgtcatcgagatatttttatgctccttactttctcttttctaagtgctgtgggatctgggaagggatttgaggggactctgtccttttattggggatcctttttatactgaaacatctgtcctaacttgagtgccccaaggtccaactctctttcctaaagaaggtgcctgaagaagtctctcttctctctgcttcgtggcccctttcttaaatttctagggctgatgctgaccatgtggtttccacaccttattggccccagaggggccctcccatgggaagatctgcagcagtctccccaaatcagtgagcacctttgagcgcccacgaagaactttctcaacacccccaattaggagctcagtgctctcttggggcaatgcagttaaaagggtgagcctcaaatctagtcattacaccagtcaacagaagtggacagggcctaggcctctcctcagctccttaaccctcctccttctgccctggattgtaacctctcccttgtccaaatctaggattcctggtaggaaaaggaaaaggcccttcccttccctccaccacttccaactggcccctttgcctgacctggacttggagaaccagaggaaaagagagggagcggaagtgggagatggagcagggcacctgttagaatcagagctgcaggatttcttgggaccctcctctctccctcactgctcccagcacctcctgacccttccctctttcaaggagaagcccatgattgcagcttgtattctttagccttattacaatctatgtgcctgacaactcaacacaccgcagggctaatgttcccaccagagctccaactgaacaaccagacagacaactctcatcatcctccagagagaaaataggccgtgtctcaaagaaaggttcttggtctatgcctctggtctgtgggctggcagggcaaccataccatacccccgccagtcctcggctcctgctgcaaagttggccatgtttcacagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatggggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccctaaa

SEQ ID NO: 3870 - DNA, 443 bp, Homo sapiens
tgtcaggttgccgtctaggtagcggttgtgcttgctgaggctgcacttgctgacactgcagctgcgacgcggctaagaggcgcagagcgaggagtcgggatttggtcgcgagcggcgacgagcatttgtgcagaatgtcatcagatgaggagaaatactcacttccagttgtgcaaaatgactccagtcgaggcagttctgtctcttcgaatcttcaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttc

SEQ ID NO: 3871 - DNA, 1674 bp, Homo sapiens
gcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggtgagcggcggccggcgggcgggagctctggcgggagccgcgccggcctgacgcgctgtcgccgctggttgcaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaat

SEQ ID NO: 3872 - DNA, 549 bp, Homo sapiens
tttccttaccaatcggctgccatccgaggagctgaggaagcctagagctctcagaagcagtcctttgagctggtgtagggcggtgtttctccaactgggctcgtggcacttttctggacaccactccaaacaaaattagactctgagcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgc

SEQ ID NO: 3873 - DNA, 7960 bp, Homo sapiens
agtgccctgggacacctcttcagtccgtggactttcccgctgcacactgccctccgaagtcggggacgcgggctcgtgagatggaagattttcgaggtatagcagaagaatcatttccaagctttctcaccaattcattatttggtaacagtgggattttggaaaatgtcactctttcttcaaatcttggcttgcctgttgctgtttctacacttgctagggatagatccagcactgataacaggtatcctgatatccaggcatcttacttagtagaagggagattttcagttccatccgggtcatctcccggaagccagagtgatgctgaaccaagagagaggttacagcttagcttccaggatgatgattctatctctaggaaaaagagctatgtggaaagtcaacgtttgtcaaatgctctcagcaaacagtcagctttacaaatggagacagcaggaccagaagaggagccagccggagctacagaatccttgcagggccaagatctcttcaacagggcttcaccactggaacaagcacaagactcacctattgattttcatttacagtcatggatgaataataaggaacccaagattgttgtgcttgatgctggaaaacattttgaagacaagactctaaagagtgacctaagccacactagcttattagaaaatgagaaacttatcttaccgacaagcttggaagattcttctgatgatgatattgatgatgaaatgttttatgatgatcatttggaggcttattttgaacaactggcaattccaggaatgatatatgaagacctagaaggaccagaacctccagaaaaaggttttaagttacctacaaatggtcttagacaggcaaatgaaaacggtagcttaaactgcaagtttcaatcagaaaataacagctctctgatttccctcgactcacactcttctgaaacaactcacaaagagtctgaggaaagccaagttatttgtctacctgggactagtaattctataggtactggagatagtagaaggtacacagatggtatgttaccattttcctctggtacttggggaactgagaaagaaatagaaaatttgaagggtattgttccagatcttaacagtgaatgtgcaagtaaagatgttctggtgaagaccctcagggctattgatgtgaaacttaactctgataattttcatgatgcaaatgccaatagaggtggttttgatctgactgaccctgtaaaacagggggcagagtgtcctcaccaaaataagacagttttgcacatggatggatgtttagacactgagactcctacggtgtccattcaagaaaatgtggatgtagcctctttgaagcccattagtgacagtggaattaatttcactgatgccatttggtcaccaacttgtgaaaggcgaacatgtgaatgtcacgagtccatcgaaaagaataaagacaaaacagatctcccacagagtgtggtctatcaaaatgaagagggtaggtgggtcacagaccttgcctattacacatcttttaatagcaaacaaaatttaaatgtgtctctaagtgatgagatgaatgaagacttcagatctggttctgaagcatttgatttgattgcacaagatgaagaagaatttaataaagagcatcaatttatacaggaagaaaacatagatgctcataatacttcggttgcactgggcgatacgtcctggggagctacaattaattacagtctgttgaggaaatcacgtagcacatcagatttggataaagatgatgccagttatttacgtctgtctttaggagagttctttgctcaaagatctgaagctcttggttgccttggtggtggtaacaatgtgaaaagaccatcatttggctattttattagatcaccagagaagagagaacctattgccttaataagaaaatctgatgtatcaagaggtaatttggaaaaagaaatggctcatcttaaccatgatctatattcaggagatttaaatgaacagtcccaggcacagctaagtgaaggatcaattacacttcaggttgaagcagtagagagtacttcacaagtggatgaaaatgatgtgacgttaacggctgataaaggcaaaacagaggacactttcttcatgagcaacaaaccccaaagatacaaagacaagctaccagatagtggtgattctatgcttaggatcagcaccattgcttcagccattgcagaggcatcagttaatactgatccttcccaacttgctgcaatgatcaaggcactttcaaataaaaccagagacaagacttttcaggaagatgagaaacaaaaggactattctcatgtgcgtcatttcttacctaatgatttagaaaaaagtaatggatccaatgcacttgatatggagaaataccttaaaaaaacagaagttagtagatatgaaagtgcattggaaaacttttcaagggctagtatgtctgatacttgggatttatctttgcccaaagaacaaactactcaagacattcatccggtggacttaagtgctactagtgtaagtgtgagggcaccagaagaaaacacagcagctattgtttatgttgaaaatggagagagtgagaatcaagagtcatttagaaccataaactcctcaaattcagttacaaatagagagaataacagtgcagtagttgatgtgaagacatgttccattgacaacaaattacaagatgttggtaacgatgaaaaagctacctcaatttccactccatctgatagttattcatcagtgaggaaccccagaataacatccctttgtctgttaaaagactgtgaagaaatacgagataacagagaaaatcagaggcaaaatgagtgtgtcagtgaaataagcaacagtgagaagcatgtgacttttgaaaaccatcgcatagtctcacctaaaaatagtgatttgaaaaatacctctcctgagcatggtggacgtggctcagaggatgagcaggagagcttcagaccttccacgtcaccactgagtcattcttctcctagtgaaatttctggaacgagttcatcagggtgtgcgttagagtcctttggttcagcagctcagcagcagcagcctccctgtgagcaggagttgtctcccttggtgtgctcgcctgctggggtgagcaggctgacgtatgtgtctgaaccagagagctcctatcctaccacagccacagatgatgccctggaggaccgcaagagtgatatcaccagcgagttgagtaccacaattattcaaggcagtccagccgcattggaggaacgggctatggaaaaattgagagaaaaagttccatttcagaatagaggaaaaggaacattatcatctattatccagaataactctgatacaagaaaagcaactgaaactacttctctgagtagcaagcctgaatatgtaaaacctgactttagatggagtaaagatccttcctccaaaagtggaaatctgttggaaaccagtgaggtaggttggacatcaaaccctgaggaattggacccgatcaggctggctctcctgggcaagtcaggtctgagctgtcaggtggggtcagccacatcacaccctgtgtcctgccaggagcctatagatgaagatcaaagaataagtcctaaagataagtcaactgctggccgtgagttcagtggccaggtttctcatcagaccacctctgaaaaccagtgtactcctattcccagcagcacagttcacagctctgtggctgacatgcagaacatgcctgctgctgtgcacgcactcttgacacaaccctctctcagcgctgctccttttgctcagcggtatttgggaacactcccttcaactggaagcaccaccttgcctcagtgccatgctggcaatgccacagtctgtggcttctcaggaggccttccctatccagctgttgcaggagagcctgtgcagaactctgtggctgtgggaatttgtctaggatcaaatatcggctctggatggatgggtacctcttccctctgtaacccatattctaataccttaaatcagaacctgctaagcacaacaaaaccttttcctgtgccgtctgttggtacaaactgtggaattgaaccatgggattcaggagtgacatcaggattggggagtgtccgagtgcccgaggagttgaagcttcctcatgcttgctgtgtcgggatcgcttcccagaccctcctcagtgtgcttaatccaactgaccgctggctgcaagtcagcattggggtcctcagcattagtgttaatggtgaaaaggtggatctttcaacatatcgttgtttagttttcaagaataaagccatcataagacctcatgccacagaagagataaaagtgctttttataccatccagtcctggggttttcagatgcacattcagtgttgcttcttggccatgttcgacagatgctgagaccatcgtacaggcagaagctttggccagcaccgtcactctcactgccattgccgagagtcctgttattgaggtagaaacagaaaagaaagacgttcttgattttggtgacttgacttatggaggctggaaagccctcccactaaaattgataaaccgaacgcatgccactgtgccaattagactgattattaatgctaacgctgtagcctggcgctgtttcacgttttccaaggaatccgtccgagctcctgtggaagttgctccttgcgctgatgtggtcactcggctagcaggcccttctgtggtcaaccacatgatgcctgctagttatgatggacaggatccagaatttctgatgatttgggttcttttccatagtccaaagaaacagatcagctcttcagatattctggactcagcagaagaattctcggcaaaagttgatatcgaagttgacagcccaaaccctacgcccgttcttagaagtgtgagtctccgagcaagagcaggaatagctaggatccatgctcccagggacttgcagacgatgcatttcttggccaaagtggcttcctcaagaaagcagcacttacctttgaaaaatgctgggaacattgaagtttatttggatatcaaggtcccagaacaaggaagtcacttttcagtggatccaaagaatctactccttaaacctggagaagaacatgaggttattgtttcatttactccaaaggatcctgaagcctgcgaggaaaggatcttgaaaatatttgtgcagccatttggacctcagtatgaggtagtgttaaaaggcgaagtcatttcttcaggaagtaaacctctgtcacctggaccttgcttagatattccatcgattttgtccaacaaacaatttctggcttggggaggagtccctctaggtagaacacagcttcagaaactagctttaagaaataattctgcatctacaactcaacatttacgactgcttattagaggacaagatcaggactgctttcagcttcagaacacttttggttcagaacagcgattgaccagtaactgtgagatcagaattcacccaaaggaagacattttcatctctgtattatttgcacctactcgattatcttgcatgttggctagactagaaatcaaacaacttggaaatcgatcacaaccaggcattaagttcacaatacctttgtctggatatggaggaacaagcaatcttattttggaaggcgttaaaaaattatctgacagttacatggtaacagtgaatggcttagtacctggcaaagaaagtaaaattgttttttctgtccgcaacactggctcccgagcagcttttgttaaagcagtaggttttaaggattctcagaaaaaagttttgctggatcctaaagtattgaggatttttccagataaatttgtactcaaggaaagaacacaagaaaatgttactttaatatataatccatcagacagaggaatcaataataaaactgcaacagaactatcaactgtatacttatttggtggagatgaaatttcaagacagcagtatcgcagggccctgttacataaaccagagatgataaaacagatacttccagaacatagtgtgcttcaaaacattaattttgttgaagcatttcaagatgagctattagtaactgaagtatatgatcttccccaacgacctaatgatgttcagctcttttatggaagcatgtgtaaaattatactttcagtaattggagaattcagagattgcatttctagcagagaattccttcagccttcttccaaagctagcttggaatctacaagcgacttgggagcttctgggaaacatggtggcaacgtctctttggatgttttaccagtcaaaggtcctcagggttctcctcttctctcacgggcggctcgcccgcctctggatcagctggcctccgaagagccgtggactgtcctacccgagcacttgattctggtagctccttctccttgtgacatggcaaaaactggacgtttccagattgtgaataactctgtgaggttactgagatttgagctgtgctggccagcgcattgcctcacagtcacgccgcagcatggatgtgtcgcgccagagagtaaactacaaattcttgtgagtcctaattcctccttatccacaaaacagtcaatgttcccgtggagtggtttgatctatatacactgtgacgatggacagaagaaaattgtgaaagttcaaattcgagaagatttaactcaagtggaacttttaactcgtttgacctccaaaccatttggaattctttccccagtatctgagccttcagttagtcatttggtcaaaccaatgacaaaaccgccttccacaaaagttgaaataagaaacaagagtattacttttcctacaacagaacctggtgaaacttcagagagctgtctagaactcgagaatcatggcaccacagacgtgaaatggcatctgtcatctttagcgccaccttatgtcaagggagttgatgaaagtggagatgtttttagagctacctatgcagcattcagatgttctcctatttctggtctgctggaaagccatgggatccaaaaagtctccatcacatttttgcccagaggtaggggggattatgcccagttttgggatgttgaatgtcaccctcttaaggagcctcacatgaaacacacgttgagattccaactctctggacaaagcatcgaagcagaaaatgagcctgaaaacgcatgcctttccacggattccctcattaaaatagatcatttagttaagccccgaagacaagctgtgtcagaggcttctgctcgcatacctgagcagcttgatgtgactgctcgtggagtttatgccccagaggatgtgtacaggttccggccgactagtgtgggggaatcacggacacttaaagtcaatctgcgaaataattcttttattacacactcactgaagtttttgagtcccagagagccattctatgtcaaacattccaagtactctttgagagcccagcattacatcaacatgcccgtgcagttcaaaccgaagtccgcaggcaaatttgaagctttgcttgtcattcaaacagatgaaggcaagagtattgctattcgactaattggtgaagctcttggaaaaaattaactagaatacatttttgtgtaaagtaaattacataagttgtattttgttaactttatctttctacactacaattatgcttttgtatatatattttgtatgatggatatctataattgtagattttgtttttacaagctaatactgaagactcgactgaaatattatgtatctagcccatagtattgtacttaacttttacaggtgagaagagagttctgtgtttgcattgattatgatattctgaataaatatggaatatattttaa

SEQ ID NO: 3874 - DNA, 540 bp, Homo sapiens
agtgtgctggaaagttctacagatttcgccatcagactatccattcctattcttgaaaaatctgcagtgctggagttatttgcaattcccccccgccaatctttaaataattgtctcagagatatagatagatatagattgcccacgggtgatttttttaatcccggttaccacttgtaataaaagaggttgaattttggagagaattgatatttaaattgcatgtttttttttctgtattataattatgcacattgatttagttttaaaattagtgaggttggaatgttagtattttgatttgaaatctgggatctttggaggtgatttaagattatggtttgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgact

SEQ ID NO: 3875 - DNA, 688 bp, Homo sapiens
atcagaaagctccgcagttcttgagttccacatgcagagcagatgcgacagctagaagtgagtagggcccagaccctggcccaggaagatccactaaaggaggccatccttccgccttcttctgcaggagtcagggggcgtgtaaaggtgatttgttcgccaagaaaagcacttttagtaaagcacagatgttaatctagatcatggaaaagtgccacacactagatttagcacataagcaaggagtctctagaacactcagaagaaaatgaatgaatccatgaatgaatggacaagtgagagcccagagcagctgaagccatgaagtgctttggaaagagaagcgtgcctgggaaaagagagtggctgagtgctaagagcagggtgaacaccatggaaaacttgaaattgaaaacatcacaattttaatgagaaaaagcgcaacccaaagtgaagagcaccattataacaaaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccac

SEQ ID NO: 3876 - DNA, 711 bp, Homo sapiens
atgcgcagtagctgtaggagggggtgggcgctccattgggcgtttctcttggtttttcctttccgcgcggcttgggcggacgtctcgtgagacgtgggacttctcgcgggaactgcattcaaatatcccaggcgcttactcgagagctagctgagcgaatgggccggcgactgtggagttagcgtcctcaatgtggacgccctgagctcccattaggagccgctggctgcggcagcaggggactagcgtgagagtttcatgagggaggagcttttttttcgtccattttgttccctaatgaatctgaactgcccagaatggaacctagtatataaggcattcaagaaatactcgttcagtgaatgactacattgacttgagacatgggggaacatcttgcaatgacctggtgccctttgaaggcaaagttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgagagttatgaacaagaaaaatatacccttcaaagagaagttgaactcaagagtcgaatgttagaaagtttgagctgcgaatgtgaagctattaaacaacaaca

SEQ ID NO: 3877 - DNA, 2219 bp, Homo sapiens
agggcttaatagttttccaagtgcttcaagacatgttagctaattggatcttcacaggaactctatgaggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttcaagagataatagagtggttggttcagcacgtgcacggcccagtcaatttcctgaacagtcttcctctgcacaacagaatgcacgtagaaaatctaattgtgtgaaagaagtagaaaaactgcaagaaaaacgagagaaaaggagattgcaacagcaagaacttagagaaaaaagagcccaggacgttgatgctacaaacccaaattatgaaattatgtgtatgatcagagactttagaggaagtttggattatagaccattaacaacagcagatcctattgatgaacataggatatgtgtgtgtgtaagaaaacgaccactcaataaaaaagaaactcaaatgaaagatcttgatgtaatcacaattcctagtaaagatgttgtgatggtacatgaaccaaaacaaaaagtagatttaacaaggtacctagaaaaccaaacatttcgttttgattatgcctttgatgactcagctcctaatgaaatggtttacaggtttactgctagaccactagtggaaactatatttgaaaggggaatggctacatgctttgcttatgggcagactggaagtggaaaaactcatactatgggtggtgacttttcaggaaagaaccaagattgttctaaaggaatttatgcattagcagctcgagatgtctttttaatgctaaagaagccaaactataagaagctagaacttcaagtatatgcaaccttctttgaaatttatagtggaaaggtgtttgacttgctaaacaggaaaacaaaattaagagttctagaagatggaaaacagcaggttcaagtggtgggattacaggaacgggaggtcaaatgtgttgaagatgtactgaaactcattgacataggcaacagttgcagaacatccggtcaaacatctgcaaatgcacattcatctcggagccatgcagtgtttcagattattcttagaaggaaaggaaaactacatggcaaattttctctcattgatttggctggaaatgaaagaggagctgatacttccagtgcggacaggcaaactaggcttgaaggtgctgaaattaataaaagccttttagcactcaaggagtgcatcagagccttaggtagaaataaacctcatactcctttccgtgcaagtaaactcactcaggtgttaagagattctttcataggtgaaaactctcgtacctgcatgattgccacaatctctccaggaatggcatcctgtgaaaatactcttaatacattaagatatgcaaatagggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgaagaagaagtctctccacagttgtttactttccacgaagctgtttcacaaatggtagaaatggaagaacaagttgtagaagatcacagggcagtgttccaggaatctattcggtggttagaagatgaaaaggccctcttagagatgactgaagaagtagattatgatgtcgattcatatgctacacaacttgaagctattcttgagcaaaaaatagacattttaactgaactgcgggataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttcagctgtaagggccatttgaaagtttggaattttaagtgtctgtggaaaatgttttgtccttcacctgaattacatttcaattttgtgaaac

SEQ ID NO: 3878 - DNA, 457 bp, Homo sapiens
aggtggcatattggtttttctggaatccgttgcgaaactgttcttatctacttaaagggaactcatttgaagtctgagtcttgagggaataggcagaacaggcatgttggaaggaaagtatgagtctcaggtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggat

SEQ ID NO: 3879 - DNA, 582 bp, Homo sapiens
agtgcctccgggtcgcggtcattttgagcccctgtctggatgacttcttgcggctgttctacccctccccctccccgcgtcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggtgactgcgggaggcgacggagtgcttctgggggtgaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaact

SEQ ID NO: 3880 - DNA, 567 bp, Homo sapiens
gacgcagatgcgaaagtggcggcctccgggcaccatttctgtgcacggaaacagaatccgggtttgaaggcagccgccgcttcgcttacccagttaggccgggcacggtggctcacgcctgtaatcccagcactttgggaggccgaggcgggcggatcatctgaggtcaggagttcgaggccagcctgaccaacatggagaaaccccgtctctactaaaaatacataattagccagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggac

SEQ ID NO: 3881 - DNA, 742 bp, Homo sapiens
tggcctgactcacaggacactaaggctccttttctgaagaagccttttaccagtctcatttaggggatgggaacaacatgtcttcacctagggactttagagcagagcctggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 3882 - DNA, 563 bp, Homo sapiens
ttttgttcgccgttactctgcgcgtaagtcgcttgtccgtggcttctctgagaagaaaagttgaaaaaggacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaa

SEQ ID NO: 3883 - DNA, 584 bp, Homo sapiens
gacgcagatgcgaaagtggcggcctccgggcaccatttctgtgcacggaaacagaatccgggtttgaagatcttctttgtgaagctttcattcaatggtgtaccacaaaagattgaaggtcatttctttaaaaagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctga

SEQ ID NO: 3884 - DNA, 605 bp, Homo sapiens
ccgaatcgcacgcggccgggtccgctctcccgggaggagagcccggcgtggaccagcgtgacgaccccagcgtgctgcggcctctccccgagggcccctccacaagggtccctgcgcgggccgggctcggccgttgccactcgggacagccatcccctcgagttcgcgctcgccgtccccgccttcacctcccgggttgggaggcgggcgactgcgcgcgaggtaaaggaacttgcgttccccggcgccgaggcggcagcagcgcagtgcacagcggcttctgaaggcggcgtcgacggggagctgcgcgtggctcccagtttcctggttacgtgcgcgccggcagagccaaaacctgcagccgaaactcccgcttctccggccagcctgcgcattcttacctgtcggggtgcggcgagtgtctcacctctctgcacttccaaggactcttgtcatctgccttaggcgggaaatgctgttgctggattgcaaccccgaggtggatggtctgaagcatttgctggagacaggggcctcggtcaacgcacccccggatccctgcaagcagtcgcctgtccacttagccgcaggaagcggccttgctt

SEQ ID NO: 3885 - DNA, 552 bp, Homo sapiens
gatacacagtttccagaactgtctgggggcgggagcgggagcgggagccgagcccgctcggagctcctcgccgccgctgccgctcccatcttaaaaccgtttctcgccggcgcgcccgccccagcccgaaggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccg

SEQ ID NO: 3886 - DNA, 1300 bp, Homo sapiens
gttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagtgaaagcaggccaggtgcggtggctcacgcctgtaatcccagccctttgggaggccaaggcgggtggatcacttgaggtcaggagttcaagaccagcctggccaacatggtgaaacctcgtctctactaaaaatacaaaaatcaaccaggcatgacggtgcacgcctgttatcacagctacttgggaagcagcggctggagaattgcttgaacctgggaagtcgaggctgcaagtgagctgagatcatgccatggcagtctagcctgggcaacagagcgagactctgtttcaaaaaaaaaaagaaaa

SEQ ID NO: 3887 - DNA, 755 bp, Homo sapiens
acgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgagggcaaggggaaggcaaggggatcttcaagagaatgtgactgtgggggattatggctttctggccaatttgttacctattgaacactaagttccaggcactgggctaggcactgggatggtgtggtgagcaaaaactgaccagtcctgccgtggagtttgctgggggagacacatgttactcaaagaatcacactaaggatagcaatttatctcaaagcttcaagttcctgccatctacatgtgcccaggtcaaccaatcaatggctcagacagataagccaacatgcatcccgccggagctgccgaaaatgctgaaggagtttgccaaagccgccattcgggcgcagccgcaggacctcatccagtggggggccgattattttgaggccctgtcccgtggagagacgcctccggtgagagagcggtctgagcgagtcgctttgtgtaactgggcagagctaacacctgagctgttaaagatcctgcattctcaggttgctggcagactgatcatccgtgcagaggagctggcccagatgtggaaagtggtgaatctcccaacagatct

SEQ ID NO: 3888 - DNA, 1079 bp, Homo sapiens
cggattcgtgaagcagttgagtgctgcagcggcagtcgtcgcccctgccgccgctgccaccgaaggaagcatcccagacaccgggaagatggaagatggtaccccaaagcatatcatccagatgacaggatttaagatggaagaaaaagaagcgctagtcaaattacttttaaaactagattgcacttttattaagagtgagaaatacaaaaattgtacacatcttatagctgaacgcctatgtaagagtgaaaaatttttagcagcttgtgcggcaggaaagtggatactaaccaaggactatataattcatagtgccaaaagtggcagatggcttgatgaaacaacttatgaatggggatataaaattgaaaaagattcccgttattcacctcaaatgcaatctgcacctaaaagatggcgtgaagaactgaaacgcactggtgctccaggagccttccacagatggaaagttgtcctccttgttagaactgataagcgaagtgattctcttataagaaagaaattcagaatgatgaagattcccaaaccaattctgtttggactgaacatagcaatgaagaaacaaacaaagatttcaggaaagatgcaggatttcttgaaatgaaaggtgccttaagagagaccatgtatagaacccagaaagaaatgcaaaatcatgaagatgttaatgttggttctattttgattcaacatcacaaaaaagaaaaattcagtggttccagtaaagatttgaaatttgttaaaatgagaaatacctttggaagccatacatatgaaaatcagaaggaaattaagaaaaaagatgaagatattcagaggagttatactttgaggagaaaacgcaagaaaggaaaagaaagcaattgcaagaaaggcgttgaacatgaaaaaataaaaagtaccttaagaaggcacatatataatagagatcagaaagaaatgaagaattctatttttgctgaatatgccaaagaatcaaaagccatggctattaagacagatgtggatgttgttgaaataaaaaataccttaaggaagcacatatatagagctca

SEQ ID NO: 3889 - DNA, 623 bp, Homo sapiens
atcccaggcgcttactcgagagctagctgagcgaatgggccggcgactgtggagttagcgtcctcaatgtggacgccctgagctcccattaggagccgctggctgcggcagcaggggactagcgtgagagttttatttcctctatttacagttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgagagttatgaacaagaaaaatatacccttcaaagagaagttgaactcaagagtcgaatgttagaaagtttgagctgcgaatgtgaagctattaaacaacaacaaaaaatgcacctggagaaattggaagaacaactaagcagaagccatggacaggaagtgaatgaactaaaaactaagatagaaaaactgaaagtggaattagatgaagccaggcttagtgaaaagcagctgaagcaccaagtagatcatcagaaggaactcctctcttgtaaatcagaggaactgcgcgt

SEQ ID NO: 3890 - DNA, 1423 bp, Homo sapiens
ctttgcggccatccacgactttcgcaccttccgccattttcctgcctgtgagggtggacagatcgcgctcgggtctcggcctcctgagtgccggtgactgcgggaggcgacggagtgcttctgggggtgtgagctggggaagttcgtggtcacggatgcgtgtggggttgctgctcagtctgtaacggcaggtgggagacggacactgggtggaggatggagtgcggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgt

SEQ ID NO: 3891 - DNA, 554 bp, Homo sapiens
gtgtttaatcgtcgccaagcgggacttactgcaagctatcaaatctgaggtcttattttgttgagtcgaaagtgaaattttcctttggccaacgtgacagggctttgtttggtggtaaaaagggttactagacacccctcattccactgccactggagggcgcatttctcagctcttgctcttcaaacctgctgaaaggaattcctagatctaaacaccagtttccttcatgtccttatcgcttcctgtccaaatctactgaaaaccccttcggctgttacttctggatgtgatgtcgcagtctttagcccatcctgtctgctagtgccatctgaaatccttcctggaacttgcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaat

SEQ ID NO: 3892 - DNA, 742 bp, Homo sapiens
tggcctgactcacaggacactaaggctccttttctgaagaagccttttaccagtctcatttaggggatgggaacaacatgtcttcacctagggactttagagcagagcctggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaacagataccgagatattcttccatttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 3893 - DNA, 1163 bp, Homo sapiens
aggcgagggggcggagcaagagaagaaaacacaaagggccggaaggaagccggggagacaggtggggtactcgggaagctggagcgggccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctttttctcttgtaagcatgcttgtcacccagggactagtctaccaaggttatttggcagctaattctagatttggatcattgcccaaagttgcacttgctggtctcttgggatttggccttggaaaggtatcatacataggagtatgccagagtaaattccatttttttgaagatcagctccgtggggctggttttggtccacagcataacaggcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaacaaaaacattgtgtctgtcactcactgaaatgtattccgtggaaggctttcaagtgaactaagcgttacatgtttttctgctctttaagaacatgtcggggcatggcgcagtggctcatgcctgtaatcccagtactttgggaggccgaggcaggcagatcatttgaggtcaggagttcatgaccagcttggccaacatggtgaaaccccatctctgctaaaaatataaaaattagccaggcgtggtggcacatgcctgtaatcccagctactgagagggaggctgaggcaggagaatcacttgaacccaggaggcgaaagttgcagcgagcagagattgtgccactgcactccagcctgggtgccaga

SEQ ID NO: 3894 - DNA, 3020 bp, Homo sapiens; identical to SEQ ID NO: 3275

SEQ ID NO: 3895 - DNA, 542 bp, Homo sapiens
agctcagctcagacggcgccctagggccgcacagagggtcgggcagtgccggagagaggtttgaaagcgccgccgccaactcgacagcgcgtcccaggaaaaactgaggaaacgcgcctggttccaggggtcggcggggaccgtggagacgctgccagcatcctcaacagcttggaaatcccatcaccttggttccctgagacttggaggactagtaggaactgacagctggctgacagaaaacttatccagggagagaagagacaaaagtgaagtgtgaaattttgaataatgttttcaggcacggccgtcgccagcatagtaccggctcctcttcttctcccagaacctcctgacaccaaccttggtgaaagaaaagctgtgacaatgctttgcattcagaatagacctctgagttgggacccaagctgtcaactgatcccaaattcctaagttcctgacttgcaggtattgagttctaacctccgaagatggatgaaggtatggaaatttcaagtgaaggaaattccttgatcaaagca

SEQ ID NO: 3896 - DNA, 3897 bp, Homo sapiens
ccttttgccttcaaccttcgagccgccacgtaatgccacgtccccgcgcatgcgcatcttggccgctgctggcggctgtttccgggcttagagggctggagtggccgccgagttggaggcggtggtggcagcagtaggagtgtgtagagtgcgggattggggcccaggccctgcggagggcgggggaagttgtcttcttttttttccggaggggccggtaaacctggtggctgaacggcaagatgaatttcctccgcggggtaatggggggtcagagtgccggaccccagcacacagaagccgagacgttcagattctgaaataataggttatgctttggacacactatataatataatatctaatgaagaagaagaagaagtagaagaaaattccacaagacagagtgaagatttgggaagccaatttacagaaattttcattaagcagcaggaaaatgtcactcttctgttatctttattggaggagtttgatttccatgtccgctggcctggtgtgaagcttcttacttctcttttaaaacaactagggcctcaggtgcaacaaattattttagtcagtcctatgggtgtttcaagattgatggacttactagcggattccagggaagttatacgtaatgatggcgtcttactactgcaggcactaacaagaagcaatggtgcaatccagaaaattgttgcttttgaaaatgctttcgagagactactggacattatttcagaggaggggaacagtgatggaggtatagtagttgaagattgtttgattttgctccaaaacttattaaaaaacaacaactccaatcaaaatttttttaaagaaggctcatatattcaacgtatgaaaccttggtttgaagttggagatgaaaattctggctggtctgcacagaaagtgaccaatctacatctaatgctacagcttgttcgtgtattggtatctcccaccaaccctcctggtgctaccagtagctgccagaaggctatgttccagtgtgggttattgcagcagctttgtactatcctaatggctactggggttcctgctgatatcctgactgagaccataaatactgtatcagaagttattcgaggctgccaagtaaaccaagactactttgcatctgtaaatgcaccttcaaacccaccaagaccggcaattgtagtacttctcatgtccatggttaatgaaaggcagccatttgttttgcgctgtgctgttctctattgtttccagtgtttcttgtataaaaaccaaaaaggacaaggagaaatcgtgtcaacacttttaccttctaccattgatgcaacaggtaattcagtttcagctggccagttattatgtggaggtttgttttctactgattcactttcaaactggtgtgctgctgtggcccttgcccatgcgttgcaagaaaatgccacccagaaagaacagttgctcagggttcaacttgctacaagtattggcaaccctccagtttctttacttcaacagtgcaccaatattctttcacagggaagcaaaatacaaacaagagttggattattaatgttgctttgtacctggctaagcaattgtcccattgcagtaacgcattttcttcacaattcagccaatgttccatttcttacaggacaaattgcagaaaatcttggagaagaagagcagttggtccaaggcttatgtgcccttttgttgggcatttcgatttatttcaatgataactcacttgagagctacatgaaagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtgttataactaaggctatttataagtccagtgaagaagataaaaaagaagaagaggtgaaaaaaacattagaacagcatgacaatattgtgactcactacaaaaatatgattcgagagcaggatctccaacttgaggaattaaggcagcaggtttctacattaaaatgtcaaaatgaacagctccagacggcagtcacacagcaagtatcacagatccagcagcacaaagaccagtataatcttcttaaaatacagctaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatgaaatcttcccaaacatctggcacaaatgaacagtcttcagcaatagtttcagctagagattctgaacaagttgcagaattaaaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaacttttgcaacagtgtattaatgtgattggttttctttttgttttaagctaaacatctaaaacaaatttcaagttaacagttcatacaactcagatttagtagtattgtttatcataaaacatattatgttcctagttttaaaaagacccaaagtatgattaatataatttattggcatttttgctgaataggtttaagtcagataatagattttaaaaaagcaaatgaggcaatgtgtcaaaatttaatgtttcataataaaaatagatacgttgacttaa

SEQ ID NO: 3897 - DNA, 631 bp, Homo sapiens
tgaggcaccttcgggcaacacccaatactcggggctccgctcggcttctttgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccaaacaaaatgctgtaacagatttgacagcagaggctgtaaatgtagctattgcagcacctccatcagagggagaggctaatgctgagctctgtcggtatctttccaaggtcctagaactcaggaagagtgatgtggttttggataagaagttgagagacttactcaagattgtaccatgcaagctggcaactagaacccaaatccttggactacttgttgaatgcagtttttctagattgtaaattaaaaatcatatctccacaacggttctggaattctggggattgccttctaatccagtttacaagtgacagaaaacctgttatgctgctttgtagtcttaccttagatttttaaatgcttatttaaatgtaaaaaaaattttttttttacatcttttaaagactatatttaccattttgttgaaaaagta

SEQ ID NO: 3898 - DNA, 348 bp, Homo sapiens
agtgcctccgggtcgcggtcattttgagcccctgtctggatgacttcttgcggctgttctacccctccccctccccgcgtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatac

SEQ ID NO: 3899 - DNA, 504 bp, Homo sapiens
gctaaagattcctggagtagttatagtaataatgtcacaggaatatagaaagaaacctggcatctttgggagacctactgatatgtgacttctccacccctccccctccttttttaacctggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatca

SEQ ID NO: 3900 - DNA, 589 bp, Homo sapiens
gcagttcttgagttccacatgcagagcagatgcgacagctagaagtgagtagggcccagaccctggcccaggaagatccactaaaggaggccatccttccgccttcttctgcaggagtcagggggcgtgtaaaggtgatttgttcgccaagaaaagcacttttagtaaagcacagatgttaatctagatcatggaaaagtgccacacactagatttagcacataagcaaggagtctctagaacactcagaagaaaatgaatgaatccatgaatgaatggacaagtgagagcccagagcagctgaagccatgaagtgctttggaaagagaagcgtgcctgggaaaagagagtggctgagtgctaagagcagggtgaacaccatggaaaacttgaaattgaaaacatcacaattttaatgagaaaaagcgcaacccaaagtgaagagcaccattataacaaaggtcatgcaggctgagtgaattatcctaaacaaatgatggaaaggcagatgtaaagtccctcatggcgaaatataacacggggggcaacccgacagaggatgtctcagtcaatagccgacccttcagag

SEQ ID NO: 3901 - DNA, 2273 bp, Homo sapiens
attctcctgcctcagcctcccgagttgctgggactacaggggtgcaccacctacgcccggctaatttttttgtatttttagtagagaacggggtttcaccgtgttagccaggatggcctcgatctcttgacctcgtgatccgcccgcctcggctgcccaaagtgctgggattacaggcgtgagccaccgcgcccggccgaaaggggggatattaatcattactccaggacgacagagggaaaatcgctttgtactggacaaactggaatgtctgaccaaccattataaagtgcacggagtgggaggaggaatagggacattttaattgtatttctaaaaagtatcttctgtggtgaatcggaaacaaaactcattctttaccacaggcagtttaagcgctgcctgaaagatcgaaggacggtaaaccacagacgtgagaaacggaactttgcgaaaacgcagtcgttttatgtaccggctactcattggagttacaccagagactcactactggagttcatcagccaatccaaagtccaagcgtgagagccagagcctgtaggagagacctgggcaggcctcagacctgaggagtggagctccgcatcactcaaccctgggggcggagctagcccaggctcccacacccgacgctctggcccacacagacgctactctgtagcatctcaggttccctctggctgcactctggaggaccacactcgttttctttttggctgccagaggcccccgcatccaccgctgagctgggagaaagatggcggcagccgtgcgacaggatttggcccagctcatgaattcgagcggctctcataaagatctggctggcaagtatcgtcagatcctggaaaaagccattcagttatctggagcagaacaactagaagctttgaaagcttttgtggaagcaatggtaaatgagaatgtcagtctcgtgatctcgcggcagttgctgactgatttttgcacacatcttcctaacttgcctgatagcacagccaaagaaatctatcacttcaccttggaaaagatccagcctagagtcatttcatttgaggagcaggttgcttccataagacagcatcttgcatctatatatgagaaagaagaagattggagaaatgcagcccaagtgttggtgggaattcctttggaaacaggacaaaaacagtacaatgtagattataaactggagacttacttgaagattgctaggctatatctggaggatgatgatccagtccaggcagaggcttacataaatcgagcatcgttgcttcagaatgaatcaaccaatgaacaattacagatacattataaggtatgctatgcacgtgttcttgattatagaagaaaattcattgaagctgcacaaaggtacaatgagctctcttacaagacaatagtccacgaaagtgaaagactagaggccttaaaacatgctttgcactgtacgatcttagcatcagcagggcagcagcgttctcggatgctagctactctttttaaggatgaaaggtgccagcaacttgctgcctatgggatcctagagaaaatgtatctagataggatcatcagaggaaatcaacttcaagaatttgctgccatgctgatgcctcaccaaaaagcaactacagctgatggttccagcatcttggacagagctgttattgaacacaatttgttgtctgcaagcaaattatataataatattaccttcgaagaacttggagctcttttagagatccctgcagctaagcacgagaagccctgccaacgtgggataagcagatccaatcactttgtttccaagtgaataaccttttggagaaaattagtcaaacagcaccagaatggacagcacaagccatggaagcccagatggctcagtgaatccttgcagaacttctgtgcacatgacatctttttccatgttgtgcagatcagtttcactatctccaaagcatttgcatcatgaccttatacatttcaatcccttttatgctggattccgtttaaagaagacattattagagcaggaagtacaagcatttaaaatatgtagttcccatatatttcagggtctctgtgtattaagctaactcagatgttttgaaagctttttctttaaacagaggtgaaatatctgtggctaaaaagtttgagatttgtgataactttgtagtcatgtaaaacttaagtgcttcatgcctctccaaatgtggttattctaataaatggagaaatgagcc

SEQ ID NO: 3902 - DNA, 514 bp, Homo sapiens
ttggggatgaggtggcgaagtggggggggaggcacgcagcagctcccgaaggcgcgctgatggaagcttaatacaggaagtgtgggagcaggctttctggaggggatgttttaggcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttat

SEQ ID NO: 3903 - DNA, 1204 bp, Homo sapiens
attcctaggctgctggctctcagacccgcagtgaggtctgacgtcatttcctgccgaaagatgaatgggagggctgattttcgagagccgaatgcagaggttccaagaccaattccccctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgcaac

SEQ ID NO: 3904 - DNA, 563 bp, Homo sapiens
cattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatac

SEQ ID NO: 3905 - DNA, 788 bp, Homo sapiens
ctgtggctctgtggtaggggaatgccaccaactccctgaggagcagccgtgtggtatgattgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 3906 - DNA, 616 bp, Homo sapiens
aagcgcttgacttgcttccagacaaaggttgtctcaagtttgttgctcaaaccgagttctggagaacgccatcagctcgctgcttaaagggaaatgctgttgtgagagagaatgaggagagaactaggtaaggctgtgagagccatcagacctcgatgcaagtccacccgcgagggaggaaaagaaggaaaccaggttgagtggaagcatcccagacagctgtgcagtctaagagaacttcagcaagattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcagcatgtacctgatgatcaaggcattcc

SEQ ID NO: 3907 - DNA, 718 bp, Homo sapiens
acttcgtttgtggctaaggttactgtaagcttttcacttaaaaacttttcctacttctttaccagataagaaaacagctaattttaatcactggcttttgttctctaggacttaactgcatcccatattacgtatttaatgagcttgaaaaaatctcagtgtttttcttatcgtttttgaccctaaatatttaaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaaagacttgcttgaaagcctgtgctgaagttagtcagtggaccaggctatgtgaactcaccatccctttggctattgagaattttctcagagaatcttctgacc

SEQ ID NO: 3908 - DNA, 2480 bp, Homo sapiens
agtttctcctttgttttacgtttgggaggaggtggcattggaaatagcagagtgcttcgcggtaacagggacaaatgtactgaggctggagcctgtgtgaacagaacagaagaggccttcactctagtagtgctcacagtccagcaggtgtttgctgaagacagcttactcagatcactactgcctggaggtggttgatatatcctggtgtaaaccttcaagaagggcacaggcaggaaaacatgagccagcaactgaagaaacgggcaaagacaagacaccagaaaggcctgggtggaagagcccccagtggggctaagcccaggcaaggcaagtcaagccaagacctgcaggcggaaatagaacctgtcagcgcggtgtgggccttatgtgatggctatgtgtgctatgagcctggccctcaggctctcggaggggatgatttctcagactgttacatagaatgcgtcataaggggtgagttttctcaacccatcctggaagaggactcactttttgagtccttggaatacctaaagaaaggatcagaacaacagctttctcaaaaggttttcgaagcaagctcccttgaatgttctttggaatacatgaaaaaaggggtaaagaaagagcttccacaaaagatagttggagagaattcgcttgagtattctgagtacatgacaggcaagaagcttccgcctggaggaatacctggcattgacctatcagatcctaaacagctcgcagaatttgctagaaagaagccccccataaataaagaatatgacagtctgagcgcaatcgcttgtcctcagagtggatgcactaggaagttgaggaatagagctgccctgagaaagcatctcctcattcatggtccccgagaccacgtctgtgcggaatgtgggaaagcgttcgttgagagctcaaaactaaagagacatttcctggttcatactggagagaagccgtttcggtgcacttttgaagggtgcggaaagcgcttctctctggactttaatttgcgtacgcacgtgcgcatccacacgggggagaaacgtttcgtgtgtccctttcaaggctgcaacaggaggtttattcagtcaaataacctgaaagcccacatcctaacgcatgcaaatacgaacaagaatgaacaagagggaaagtagtcctccaacaggatgaagcagattaacagaagagtgatcagtgacaaacatgcctcattgattattgtttctaggaaggaatttctaaatcaatattgcaaccccaaaagcggttataatttggtgttactaagatgctcctacactttgtgataccgttttaaggacatggtgcatttttttttcttttatttgttttatttagaactttttttatttgttttatttagaactttgtgtgttcttaaagtgtgcttccaacaggaaggtcagtgataaattttcaaaagcataaccttcaatatattatctgttggattattggatataagacttattttcatgtactataaatatgaaaataactttgatttttaattgtgtagtttccatttcttagcttttgccttttaaatttatacttcagccaggcatagtgactgatgcctgtaatcccaacactttgttgggaggccaaagcaggaggatagcttgaggccaggagttccagaccagcctgggcaacatagtgagatcctgtctctacaaaaaaatttgtttttatttgtatttatatatttttatttttgtttttgttggtaggcgtctcgctctgtcacccaggctggagtctagtgtcgtgatcttggctcactgcaacctccacctcccgggttcaagtgattctctggcctcagcctcccaagtagctgggactacaggtgtgtgtcaccacgcccggctaatttttgtatttttagtagagatggggtttcaccatgttggccaggctagtctcaaactcctgacctccagtgatctgcccacctcggcctcccaaagtgctgggattacaggtgtgagccactgtgcctggccccccacaacatgtttaaacttagctaggcctggttgcatacgcctgtgttcccagctactcaggaggctgaagcaggaggatagcttgagcccaggagtttgaggctacagtgagctgtgattgcaccactgtactccagactggataacagcaagagcccatcttttaaaaaaagtaaaaattaaaaatatacttcatggttcatgtcatagccctagagaatgaaaaatttgcagtagatagtcaataaatgaatcagtagttaaatattccttaaagtcaactgtatttcattgtgatttttgttttctttttatcattgtatcaaactatatggaaatcatatggttagatgtgattatttgataatgttagtccatttgaatccattttagatatttcacaattaaagaatatgaaacttc

SEQ ID NO: 3909 - DNA, 559 bp, Homo sapiens
cccacgtggtggaagcccggccctgcaggctggagaggatttgattagactacgcgtttcgacttgcagggtgtttaatcgtcgccaagcgggacttactgcaagctatcaaatctgaggtcttattttgttgagtcgaaagtgaaattttcctttggccaacgtgacagtttccttcatgtccttatcgcttcctgtccaaatctactgaaaaccccttcggctgttacttctggatgtgatgtcgcagtctttagcccatcctgtctgctagtgccatctgaaatccttcctggaacttgcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcg

SEQ ID NO: 3910 - DNA, 945 bp, Homo sapiens
ctgtggctctgtggtaggggaatgccaccaactccctgaggagcagccgtgtggtatgattggtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaacagataccgagatattcttccatttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 3911 - DNA, 1244 bp, Homo sapiens
ctgtggctctgtggtaggggaatgccaccaactccctgaggagcagccgtgtggtatgattggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 3912 - DNA, 1401 bp, Homo sapiens
ctgtggctctgtggtaggggaatgccaccaactccctgaggagcagccgtgtggtatgattggtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 3913 - DNA, 788 bp, Homo sapiens
ctgtggctctgtggtaggggaatgccaccaactccctgaggagcagccgtgtggtatgattgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaacagataccgagatattcttccatttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 3914 - DNA, 693 bp, Homo sapiens
ctgtggctctgtggtaggggaatgccaccaactccctgaggagcagccgtgtggtatgattggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaacagataccgagatattcttccatttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 3915 - DNA, 457 bp, Homo sapiens; identical to SEQ ID NO: 3878

SEQ ID NO: 3916 - DNA, 676 bp, Homo sapiens
aatacaattagagaaccataaagggcaaacatattaaaagagcttaattttgtagtgtggcctgcaggcttccagaaaaaaacaggagatcagtgagctagcagcagagaagccttcctggaaaaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactg

SEQ ID NO: 3917 - DNA, 567 bp, Homo sapiens
ggccgggcgtccccgcggcgctcctcgtggggcggggcgcaggcggggcggggccccctctccagccgcccgccctccggccgcgtccccgccggccctgcagacgtggcggggcgggacccgctgggcactcccgcgcgtactcggccgcctgagcgatactaaaatgtctgatgatgctggtgacaccttagccactggagacaaagcagaagttactgagatgcctaatagtgattctttacctgaggatgcagaagtgcattgtgattcagctgcagtttcacatgagccaacaccagctgaccccagaggggaggggcatgaaaatgcagctgtgcagggtgcaggggctgccgccattgggccccctgtgcagcctcaggatgccaacgccctggagccccctctcaatggagacgtgactgaggatacacttgctgaatgtattgattccgtcagccttgaggcagaacccagatccgaaatacccctgcaagaacagaattatctggctgtggattcccctccaagtggaggaggatgggcaggctggggatcctgggg

SEQ ID NO: 3918 - DNA, 564 bp, Homo sapiens
gctcaaagtggcggagcgcggcggcgggaggcaggtgcacggcacccgccagtgggggtgcctcaacttccgcgggcgtttaaatagcagcctctctcccctcccaccggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctc

SEQ ID NO: 3919 - DNA, 1524 bp, Homo sapiens
aacattcagtacaatctgctgcccaggacctggacattgacagataaaatgaagaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcagggatagactccacaaataataaaaaggaagagtatggtcctggtgttcaaggaaaagaacattctgctcatttggatccttcagctcctccgatgcccttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtg

SEQ ID NO: 3920 - DNA, 591 bp, Homo sapiens
cagagtttatcaactactgccctgaagggcgcttttctgttttagctgctttcaagcaaatctgtgtcttttagaattgtcaaccttcagctctttttggttgggcaaaattaaacagttctatttttaataacagcgaagaaacatatgtatttaatattgggatcatttaccacgagcgattacatgaggcatggtttcttaaacgctaaagtggcttaaaaaagggaatttagttggatataaaagtaaatttcagagcaaagtctgaaatggatgttacatgagtcattttaagggatgcacacaactatgaacatttctgaagattttttctcagtaaagtagataaagatggatgaatcagccttgttggatcttttggagtgtccggtgtgtctagagcgccttgatgcttctgcgaaggtcttgccttgccagcatacgttttgcaagcgatgtttgctggggatcgtaggttctcgaaatgaactcagatgtcccgagtgcaggactcttgttggctcgggtgtcgaggagcttcccagtaacatcttgctggtcagacttctggatggcatcaaacagagg

SEQ ID NO: 3921 - DNA, 854 bp, Homo sapiens; identical to SEQ ID NO: 3827

SEQ ID NO: 3922 - DNA, 578 bp, Homo sapiens
agatgattccctgattctccagagagattacacacttcgtttgtggctaaggttactgtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaaagacttgcttgaaagcctgtgctgaagttagtcagtggaccaggctatgtgaactcaccatccctttggctattgagaattttctcagagaatcttctga

SEQ ID NO: 3923 - DNA, 782 bp, Homo sapiens
gctttgtgtaactgggcagagctaacacctgagctgttaaagatcctgcattctcagcatgctcttcactaggatttgcaaaggtaactgccacacagagccatctttaccttcctaacaccccctcccgccccttgccatgtgctgggagatgtggacctggcctggggacagggtgtttctcagggccttgtctcaacttctcccacaacctctgtgttgtgtctgtcccctgccctgcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccacaatggtgggttgccccgaatcccattcagcaccttccagtttctctacacgtatattgccgaagtggatggggagatctgtgcatcacatgtcagcaggatgctaaactacattgaacaggaagtaattggtcctgatggtttaatcacggtgaatgactttacccaaaaccccagggtttggctggagtaacagcacaattttggcaattttaaaggaagatacagaggtgattgtacttcagaatgataaacccatataccacctaaaatcaattttcttgtacaactggtacacactaataaacaaacatgtgagatcagaaa

SEQ ID NO: 3924 - DNA, 577 bp, Homo sapiens
aaaagaggttgtgtcgacggaggcagaagcgacgcagatgcgaaagtggcggcctccgggcaccatttctgtgcacggaaacagaatccgggtttgaaggcagccgccgcttcgcttacccagtacctagtgttccgtcgtgtttgaccaacccccctctccctgccaccgcgggtttaatccgaacgtgttcggatactggaactcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcc

SEQ ID NO: 3925 - DNA, 1134 bp, Homo sapiens
ttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacggtagccaaatgctaggaggcatgggtttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaat

SEQ ID NO: 3926 - DNA, 545 bp, Homo sapiens; identical to SEQ ID NO: 3841

SEQ ID NO: 3927 - DNA, 685 bp, Homo sapiens
aaaagtgtagcaacaactgagtttgctgtctcactaccctcagcctaggccaacctggactccttcaccccaaatgaggtgaccgctacattttatatgaagacactgatttaccattcaactgtgatccatcttataacatggcaatccaatacagacaggaagataaaactcaacaacagctaaaataaagtgtattcccagaatacacattgcagaaaaaggatgaagttgaccagtgaaaagttgcccaagaaccccttttatgcctctgtatctcagtatgctgctaaaaaccaaaaatttttccagtggaaaaaggaaaagactgattacacccatgctaatttggtggataaggcattgcagctcttgaaggaaagaatactgaaaggagacactctggcatatttcctacgaggtcaactatattttgaagagggatggtatgaagaagcattagaacagtttgaagaaatcaaggagaaagaccatcaagcaacttaccagctaggagtgatgtactatgatgggctggggaccactctagacgctgagaaaggggtggactatatgaagaaaattcttgattctccatgtcccaaagcaagacacttaaaatttgcagctgcttacaacctcggaagagcttattatgaaggaaaaggtgttaaacgatcaaatg

SEQ ID NO: 3928 - DNA, 629 bp, Homo sapiens
gatgtgggtgagttcatttgctcgcgtgcaggggaagtctggagaaggcattgtttcaattattaaaagtgtgggggcagtgggcggaacaaacgcgccgactacagaggctggacttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgattta

SEQ ID NO: 3929 - DNA, 3560 bp, Homo sapiens
cataacaagccaaacgccagaccgagagtgcctccgtgcgcgagtgcccggtgtgtgcgcgccggcgagagcaggggcccgcccggctccccgcccgccgcggcccgaactcatgcagctccgagcgagcgagcggcgcccagcccagcgcctcggccgaacccctccgcagcaggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtgagcattggcagcccagagaagatggagcccatcaccaaggtgtcacacattcccagcagccggtgggcgctagtgtgcagcctctgcaatgagaagtttggggcctctatacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggtaatgattgacactgacaccttatagtgacttagagaagaagatgcaaagaggcgaacgctcgcccagagcaagaaatgatagccagtcatatactctcagacccttgtacacaccacagcatgaggttgtgttggttaaaaatatttatgggctggtaaactcattgtacatatgtgcaaaactgctactgagtggggagcttctttgtggtttttttttttttaaaaacactttcccattaatctttactgttttgtaagatcaaatggggtgtgtcttccccacccccattccttcattctagagctagagtgaatgagccccaagaaaatgacccaaggagttgactcaggatggtttacagactgatttagaaaaccagaacggatttcatttctaatggagggggccagagatgggaaaatttcttgttcagtccggggaaacacacctaggtgctggtgatgggcttatgaaggaagctaagcacggctgctcactggcccccactttgtttcttgggtaattcacaggggaattcccagtactgtcatggagcagagcaggcagtgggtgctgatgtgtgtgcatgagctgtatgtacacatgcatatatctgttacagaagatactcctggcagtgaggtgctaagtcatcactgaggctgtgtgtgtgtgtgtgtgtgcgcgtgcccgtgtccatccatgtctctgttgtgtgtctgtgtgcgggtatgggtgggattcctggtggacaggggtgtcagatctgtctgaggagccccagtcatgctcagcacgctacagatgtgttgtttgtcacactgagattgctgaatgtcgtggctgttggctgccgagcctcagctgctggcatttccttctgctgtttgctgcttttgtgcctcccccactttccatcacctctggagtcccgtctggacgtcccttcctgctacaggaataatgaggcgtgggctgcctcccgctagggcctcctgctccctgtaggtagtttctggctgaggcttgctaattggggatgcttcttagagcatcttccacatcaactcccctggctgctggctaccgattaaattcattagtgtgaaagaggtgggagtgaggttttctggcctgaagcagtctgcactgaaaggtacccaagtggcctgaaacagtgtagggaaagacctgggaaacactggaccaaaaaagcctgatctcatggagacctgcatggccctgttagagatggcgtagaagtgaaagtcttaaagggagcattagagatccttttaatacacgactgagtgccagcttatttgtgatgccccttcccagaccaggttaggattcctgggaaggccgcggattccggccctggaagaggcaggatcctggagcagttttgtgaggcttttgtgctcccatacgccccctggtggtgagtgtaaagaagactttgcctctcacaactacatgtatgtgtggcatttttgttagagatgagaaaaggattgagaaggataaactggaatcctggtaagaagcctttatgccagcccgacacctgctgtaattggggtgcatgagctatggagtcagatagttgttgggagggggaggacaagaagtctattgtttggactgtgtttgtctcacaatcaccacaaaataaaagtgtagaaaatgcttgtggtgtactaactcttttctgtacttaagttactcagattaacatgcacttctaattctaaacattttttttggagtcatcactgtcgctgtttaagtagaacaatgccaacgatgtatgagaaacagggaataaatcaggatttgtgtgtgta

SEQ ID NO: 3930 - DNA, 441 bp, Homo sapiens
agtgcctccgggtcgcggtcattttgagcccctgtctggatgacttcttgcggctgttctacccctccccctccccgcgtcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggtgactgcgggaggcgacggagtgcttctgggggtgtgagctggggaagttcgtggtcacggatgcgtgtggggttgctgctcagtctgtaacggcaggaaagatgaatgggagggctgattttcgagagccgaatgcagaggttccaagaccaattccccacatagggcctgattacattccaacagag

SEQ ID NO: 3931 - DNA, 1339 bp, Homo sapiens
ctgtggctctgtggtaggggaatgccaccaactccctgaggagcagccgtgtggtatgattgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaacagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 3932 - DNA, 573 bp, Homo sapiens
ctgcgcagaccccgcctcccaccgcaggggcacgcctcctacccccacccttcgcggattgatcctgctggccgcagccacccacgtggtggaagcccggccctgcaggctggagaggatttgattagactacgcgtttcgacttgcagggtgtttaatcgtcgccaagcgggacttactgcaagctatcaaatctgaggtcttattttgttgagtcgaaagtgaaattttcctttggccaacgtgacagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaa

SEQ ID NO: 3933 - DNA, 859 bp, Homo sapiens
atgaaaggatggggacctcaccagagaggactggtctcagcaatgtccttaagtggtcaaaacatgctgcggttgagtctccacccacatttgcacaaaggaccatcacctgtccttcctggaatctctaaagttttctgctttccttctgtcctgatggccagctctgctaagtcagctgagatgcccaccatctccaaaaccgttaaccctactcctgatcctcatcaagaatatctggaccctaggattaccattgccttattcgaaattggatcacattccccttcctcctggggctctctccctttcctaaagaatagcagccatcaagttacagaacaacagactgcacagaagtttaacaatctcttaaaagaaattaaagatattcttaaaaatatggcaggttttgaagagaagatcacagaagcaaaagaactttttgaggaaaccaatattactgaggatgtgtcagcccacaaagaaaatatcagaggacttgacaaaatcaatgaaatgttatcaacaaacctgcctgttagtttagccccagagaaagaagacaatgaaaagaaacaggagatgatattggaaaccaatattactgaggatgtgtcagcccacaaagaaaatatcagaggacttgacaaaatcaatgaaatgttatcaacaaacctgcctgttagtttagccccagagaaagaagacaatgaaaagaaacagcagatgataatggaaaaccagaactctgagaacaccgcacaagtttttgcaagagatttggtaaatcgtttagaagaaaaaaaagtccttaacgaaactcaacaaagtcaggaaaaagcaaaaaacagactta

SEQ ID NO: 3934 - DNA, 3692 bp, Homo sapiens
agcacttgaagttcaggcagcgagagttgacatggggccagggctgcgcccctggggcgggttgaagacagggtgagtctcttgatattcaggaaatcatcgcgcacccagtcaccagcgttcgggagcctgtcgcagcgggaccgacggaatccggagcaggcgacagggcgcagaagcgggatgtacttctgttggggcgccgactccagggagctgcagcgccggaggacggcgggcagccccggggctgagctactgcaggcggccagcggggagcgccactctctgctgctgctgaccaaccacagggtcctctcgtgcggagacaacagcaggggtcagctgggccgcaggggcgcgcagcgcggggagctgccagaaccaattcaggcattggaaaccctaattgttgatctcgtgagctgcgggaaggagcactccctggctgtgtgccacaaaggaagggtcttcgcatggggagctggttctgaagggcagctggggattggagaattcaaggaaataagtttcacacctaagaaaataatgactctgaatgatataaaaataatacaagtttcctgtggacactaccactccctggcattatcaaaagatagccaagtgttttcgtggggaaagaacagccatgggcagctgggcttggggaaggagttcccctcccaagccagcccgcagagggtgaggtccctggaggggatcccactggctcaggtggctgccggaggggctcacagctttgccctgtctctctgtgggacttcgtttggctggggaagtaacagtgccgggcagctggccctcagtgggcgtaatgtcccagtgcaaagcaacaagcctctctcagtcggtgcactgaagaatctaggtgtggtttatatcagctgtggtgatgcacacactgcggtgcttacccaggacgggaaagtgttcacatttggagacaatcgctctggacagctgggatacagccccactcctgagaagagaggtccacaacttgtggaaagaattgatggcctagtttcgcagatagattgtggaagttatcacaccctggcatatgtgcacaccactggtcaggtggtatcttttggtcatggaccaagtgacacaagcaagccaactcatccggaggccctgacagagaactttgacattagctgcctgatttctgctgaagacttcgtggatgttcaagtcaaacacatttttgctggaacatatgccaactttgtgacaactcatcagtgaaattagaatgatattttcatctcctgcttgtctgactgcaagttttttaaagaaaagaggaactggagaaacgacttccattgatgtggacttagaaatggcaagagataccttcaagaagttaacaaaaaaggaatggatttcttccatgataactacgtgtctcgaggatgatctgctcagagctcttccatgccattctccacaccaagaagctttatcagttttcctcctgctcccagaatgtcctgtgatgcatgattctaagaactggaagaacctggtggttccatttgcaaaggctgtgtgtgaaatgagtaaacaatctttgcaagtcctaataaacaaagctaactgtcgactaccagaaaatactttcaacataaatgaactctccaacttattaaacttttatatagatagaggaagacagctctttcgggataaccacctgatacctgcagaaacccccagtcctgttattttcagtgattttccatttatctttaattcgctatccaaaattaaattattgcaagctgattcacatataaagatgcaggctggagtacaatggtgcaatctcagctcaccacaacctctgcctcccgggttcaagcgattcttctgcctcagcctcccaaatgtcagaaaagaaagcatacatgcttatgcatgaaacaattctgcaaaaaaaggatgaatttcctccatcacccagatttatacttagagtcagacgaagtcgcctggttaaagatgctctgcgtcaattaagtcaagctgaagctactgacttctgcaaagtattagtggttgaatttattaatgaaatttgtcctgagtctggaggggttagttcagagttcttccactgtatgtttgaagagatgaccaagccagaatatggaatgttcatgtatcctgaaatgggttcctgcatgtggtttcctgccaagcctaaacctgagaagaaaagatatttcctctttggaatgctgtgtggactctccttattcaatttaaatgttgctaaccttcctttcccactggctctgtataaaaaacttctggaccaaaagccatcattggaagatttaaaagaactcagtcctcggttggggaagagtttgcaagaagttctagatgatgctgctgatgacattggagatgcgctctgcatacgcttttctatacactgggaccaaaatgatgttgacttaattccaaatgggatctccatacctgtggaccaaaccaacaagagagactatgtttctaagtatattgattacattttcaacgtctctgtaaaagcagtttatgaggaatttcagagaggattttatagagtctgtgagaaggagatacttagacatttctaccctgaagaactaatgacagcaatcattggaaatactgattatgactggaaacagtttgaacagaattcaaagtatgagcaaggataccaaaaatcacatcctactatacagttgttttggaaggctttccacaaactaaccttggatgaaaagaaaaaattcctctttttccttacaggacgtgataggctgcatgcaagaggcatacagaaaatggaaatagtatttcgctgtcctgaaactttcagtgaaagagatcacccaacatcaataacttgtcataatattctctccctccctaagtattctacaatggaaagaatggaggaagcacttcaagtagccatcaacaacaacagaggatttgtctcacccatgctcacacagtcataatcacctctgagagactcagggtgggctttctcacacttggatccttctgttcttccttacacctaaataatacaagagattaatgaatagtggttagaagtagttgagggagagattgggggaatggggagatgatgatgatggtcaaagggtgcaaaatctcacacaagactgaggcaggagaatagggtacagagatagggatctaaggatgacttggacacactccctggcactgaagagtctgaacactggcctgtgattggtccattccaggaccttcatttgcataaggtatcaaaccacatcagcctctgattggccatgggccagacctgcactctggccaatgattggttcattccaggacattcatttgcataaggagtcaaaccacaccagtcttggattggctgtgagccaattcacctcagtctctaattggctgtgagtcagtctttcatttacatagggtgtaaccatcaagaaacctctacagggtacttaagccccagaagattttgctaccagggctcttgagccacttgctctagcccactcccaccctgtggaatgtactttcacttttgctgcttcactgccttgtgctccaataaatccactccttcaccaccc

SEQ ID NO: 3935 - DNA, 583 bp, Homo sapiens
gcacattcactatccaagctgcaccatcttcggggtcattgtgtgccaggcatatcaactcttttcaataaaaatgtttttctagccacttcccagcactcgcagcatgaagctcacaccagaagtttccagagatcaccccagaggtgataagatctcgcccgcccttccgtcccaggatagtgtgattgcgggaccatggaatttacaaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccc

SEQ ID NO: 3936 - DNA, 2569 bp, Homo sapiens
gccggaacaaaaatgcctcagtttggaggtcgcgctcactgcgacggcaggctttgagtgtagcacttggtagttcttcctctgctctgcttcccttcggaggaaaatttcaggctgaaggtttagcgggtgccgcctctaaagagagcaatcactacacttatggctgggattttgcgcttagtagttcaatggcccccaggcagactacagactgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataagaatcaagcccttgaagttgccacaaggacttccagcagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaagatggtgagaaagtgttttcattaaaatatgttttcaaaaccattttcaggccgggcacggtggctcacctgtaatcccagcactttgggaggccaaggcgggcagatcacctgaggtcaagagttcgagaccagcctgaccaacatggagaaacccccatctctactgaaaatacagaattagccaggcatggtggcacatgcctgtaacccagctactcgggaggctgaagcaggagaatcacttgaacccgggaggcagaggttgcagtgagctgagatggtgccactgtactccagcctgggtgataggatgagactccatctcaggggaaaaaaaaaaatttttttttcactgactaaacctgctgcagctctcttttactacagacttggagattttagtttaatttggtttaattctctgtcctttccctttcactgtttcactccaaaacatgtaagaatggcaatgtttgaacatctgcgtttgggtctactgccaccttagcaagcctcattaaccattttataaaaattgcgttagtattgttgttgttgtttttgagacagggtcttgctctgtcacccaagctggaatacagtggcatgatttcagttcactgcagcctcgacctcccaggctcaagtgatcctcccacctcagcctccagagtagctaggactacaggcagtgtgccaccacatccagctaattttttaaagttttttcatagagacagggactcactatgttgtccaagctggtctcaaactcctgggttcaagccatcctcccacctcagcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctattttagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggcaactgcagttttaattccatagttattgaatatccagtgtgtgtaaggcctggaggggagccaaaggacactaacttctaagagctccgtctagttggagagaaacctgtgtgccacaacatacagtgtccttgcttatgtggggtcgaagacatctgtgaaaataaaagcagcctctgctaatttagcgcca

SEQ ID NO: 3937 - DNA, 594 bp, Homo sapiens
gcctccgggtcgcggtcattttgagcccctgtctggatgacttcttgcggctgttctacccctccccctccccgcggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatct

SEQ ID NO: 3938 - DNA, 599 bp, Homo sapiens; identical to SEQ ID NO: 3821

SEQ ID NO: 3939 - DNA, 549 bp, Homo sapiens
gcattttaccggcttggcctctgacggggatggggatgggggtgggggagcgggaagaccagcgatttcacatttagagaaccgactgctggtcggaggccgagatggggggaaagagccagttccgtcgccttaaactgccgtctggttgtcaggcctccccggtttcgtcgtcgaccatgctgctttcttttttgccacttcttgggagaaaaatgtggagaatatcgcgctgagccatgaataagggtgggggagcaatgggaagaaatattcgatgggcttctccaaggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttca

SEQ ID NO: 3940 - DNA, 572 bp, Homo sapiens
agtgacgttacttccctttttccggtccgccggattatgaatgacggccggcgcgagtattttccacataaggtggctgtcgtttttctcctggcgtctgtggaggcgagtggtctgcgggcagcagctcccagaggcagccttggaattccagctcggactgggcgggaaggcgcaggcggcccaggtcgccgacacgctcacgcaccctccctgcctggccgcgcctctgcgaccaggtaaagagggcgctcgggccgccggcttctcagcctccgcgaccccctaagaactggtcttttcttcgggggtctgcagggctgaggatgcgggggaagggtgggaaggacaagggcgtggtatcatcgtcctgatttttctcccgccctggggccgcctcaaactcctttttggccactcctgctgaaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactg

SEQ ID NO: 3941 - DNA, 566 bp, Homo sapiens
aacggcgggaaggctcaggggcgtgcttgcggcaaccctgtaaccgccggtgcgcaagttggaggggcaaggggctgccgtgtcctggtctggaggcggcccaggctgccttggtgattctggcttcgcggcctcatggcttgcggccggtttgcgcaacggcctgcgaaccaccaggcgcgtccccgccggcttgggtccgccccgaagcccagtccctcggcctggcccgctatgccctgcacactggcggagtctggcgtggcgcagcccggcgtggggttcggccccgccaggtggtcagcccttcctcggagtccaggtggctgggggcgcttcggagagtggccagttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagt

SEQ ID NO: 3942 - DNA, 818 bp, Homo sapiens
ctgtggctctgtggtaggggaatgccaccaactccctgaggagcagccgtgtggtatgattggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatgacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 3943 - DNA, 3000 bp, Homo sapiens
cgcgcgtgtgtccgcgcgtgtccgcgtgtgggtccgtgtgcgcgtcccggtcccgcggcggcgacggcggcggcggcggcggcggctgcaggacgagccgagaggctcagccatatttgatggttttgttgctttgctcgggagttctcgggagtaatttaatgccgaaggtcgctgcctagtggaaataatataatacgtcattaatatggcgccaaaagattgggttctcgatctgtagcgaggagggagggaggcagccgctgagcgcagcgttactatcccaccagtaacttgggcattgccggggcgggggccggaggaggaggagaggatgatttttggatcctgagaattgatctatgttggatcagctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtgagcattggcagcccagagaagatggagcccatcaccaaggtgtcacacattcccagcagccggtgggcgctagtgtgcagcctctgcaatgagaagtttggggcctctatacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggttcggaacctcacttacatggtgacccgcagggaaaagattaaacggtctgtgtgcaaagtccaggaacagatattcaatctttacactaagcttttggagcaagaaagagtttcaggtgtgccttcttcctgctcctcctcctcactggaaaacatgcttttgtttaacagtccttctgttggccctgatgctcccaagatagaggacttgaagtggcattctgcattcttcagaaaacaaatgggtacttccttggttcattcgctgaaaaagccccataagcgagatcctttgcagaatagccctggaagtgaaggcaaaaccctgctgaagcagccagacctgtgtggtagaagggaggggatggtggtcccagagagctttttgggtttagaaaagacctttgcagaagcacgtctcatatcagcacaacagaaaaatggtgtggtgatgccagaccatgggaaaagaagagacaatcgttttcattgtgatctcattaaaggagacttaaaggacaaatcttttaaacagagtcacaagcctctcaggtccacagatgtgtcccagaggcatctggacaacacaagagctgccacctcccctggagtggggcagtcagcacctggcacaaggaaggagatagtgcccaagtgcaatggctccctaatcaaagtaaactataatcagactgcagtcaaagtgcctacaacacctgccagcccagtgaaaaactggggaggattccggattccaaagaagggggaacggcagcagcagggagaggcccacgatggggcctgccaccagcactcagactacccatatttgggcttaggccgagttccagccaaggaaagggcaaaaagcaaattaaaatccgacaatgagaatgacgggtatgtccccgatgtggaaatgagtgactcagagagtgaggcatcagaaaagaaatgtatacacaccagcagcactatcagcagaaggacagacattatcaggagaagcatcttggcttcttgatgcaacagagatgatgcggaagccctttgggctcgtcattgggtttgctagaggagagctctgatgtggggg

SEQ ID NO: 3944 - DNA, 2747 bp, Homo sapiens
gcatagctaacttgcacattcactatccaagctgcaccatcttcggggtcattgtgtgccaggcatatcaactcttttcaataaaaatggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagccctgtcaatgaagacaatcaagatggtgtcacgcactctgatggtgctggaaatctagatgaggaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggctccacactacaggttcaagagaagagtaatacgtggtcctgggggattttgaagatgttaaagggaaaagatgacagaaagaaaagtatacgagagaaacctaaagtctctgactcagacaataatgaaggttcatctttccctgctcctcctaaacaattggacatgggagatgaagtttacgatgatgtggatacctctgatttccctgtttcatcagcagagatgagtcaaggaactaatgttggaaaagctaagacagaagaaaaggaccttaagaagctaaaaaagcaggaaaaagaagaaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactagcactcaactttggtcattctgctgtgttcattaggtgccaatgtgaagtctggattttaattggcatgttattgggtatcaagaaaattaatgcacaaaaccacttattatcatttgttatgaaatcccaattatctttac

SEQ ID NO: 3945 - DNA, 913 bp, Homo sapiens
ctgtggctctgtggtaggggaatgccaccaactccctgaggagcagccgtgtggtatgattgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatgacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 3946 - DNA, 805 bp, Homo sapiens
ctcgaatgcagcgtctacgcctggtgaatggacgcactcttaccaattctgctctgggagatgcagcggtaacctaccgagcgcagaggccggcgcgcacccgtggagcccgcgctcgcgatccctcctcgtgccagggccccagggcagtcaaggcctgccgaccgttaggcgggtcaaggggtacacagggtgcgaattcgttaggcaaaagctgggtacaggcgcgagccacaggcacggaaacctcgcgccgaccggggccctaggcccgacgacggcagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaa

SEQ ID NO: 3947 - DNA, 759 bp, Homo sapiens
atggcggcgacggcccgggaagatggcgccagcggtcaagagcgaggtcagcggggctgcgagcactatgacagaggatgtctcctaaaggcaccttgctgtgacaagctttatacttgccgcttgtgtcatgataacaatgaagatcatcaactagatcgctttaaagtgaaggaagtgcagtgcataaactgtgaaaaaattcaacatgcccaacagacttgtgaagaatgtagcacattgtttggagaatattattgcgatatatgccatttgtttgacaaagataagaagcagtatcactgtgaaaactgtggaatttgtaggattggtccaaaggaagattttttccattgtttgaaatgtaacttatgcctagctatgaatcttcaaggaagacacaagtgtattgaaaatgtgtcccgacagaattgtccaatatgtttggaggacattcacacatcccgtgttgttgctcatgtcttgccatgtggacatcttttacatagaggctacagatgtccattatgtatgcactctgctttagatatgaccaggtattggagacagctggatgatgaagtagcacagactcctatgccatcagaatatcagaacatgactgtggatattctctgcaatgactgtaatggacgatccactgttcagtttcatatattaggcatgaaatgtaagatttgtgaatcctataatactgctcaagctggaggacgtagaatttcactggatcagcaatga

SEQ ID NO: 3948 - DNA, 818 bp, Homo sapiens; identical to SEQ ID NO: 3942

SEQ ID NO: 3949 - DNA, 5361 bp, Homo sapiens
gcctcctccgccacctccaccgatgtggaatccaatgattcctgcttttgacctcttccaaggaaaccatggctttgtagctcctgttgtaaccacagctgcacactggagatctgtcaactacacatttccaccctcagttatttctcacacttccccaacaaaagtatggagaaataaagatggaacaagtgcttatcaagtacaagaaaccccagtttctcaggttgtaagaaagaagacatcttacgttggactagttcttgttcttctcagaggtcttccgggatctggaaaatcttttttggcaaggactttgcaagaggataatccaagtggagtcattcttagtactgatgattatttttatataaatggacagtaccagtttgatgtaaagtacttaggagaagcacatgaatggaaccagaatcgtgcaaaagaagcatttgagaagaagatatctcctataattatagataatacaaacctacaggcatgggaaatgaaaccatatgttgctttgtctcagaaacacaaatataaagtcctttttcgggaaccagacacatggtggaagtttaaaccaaaggaacttgcaaggcgtaacattcatggggtaagcaaagaaaaaataacaagaatgttggaacattatcaacgttttgtttcagtgccaataattatgagttcttcggttccagagaaaattgaacgtattgagttgtgtgcatattcttgtgaggatagaagcactagcccaagagacgatgaagatattatctctgaaaaagaagaaaatattttatctttatctttgaagcatctagagttcactgaagagaagaatcttgatgtaaccaaagaaacaatgttacctgagaatgttgcatatctctctaatgcagatttaaacaaaagaagaaaagaaataagtgatatgaatcctagcattcaaagtgctttaattctggaaactccacacatgtatttttctgactctgaaagcaaactacaggcaacagacaaaagtgaaaacgagcaaatagaaatggtggctgtaaaagggtatagtaaaactgacacagatagttctatggagagagtatcacctagtacttgctgtagtgaaaataatcaagaagactgtgatcttgcaaatagtggaccacttcaaaatgaaaaatcctcacctggtgaaatagtggaagaaagagcaacagtaacgaaaaaagcctttgggaaacaaaaaagcaaatcgactttggaaaagttcccaagacatgagctatcaaattttgttggtgactggccagttgataagactattggtcagaggacaaaaaggaacagaaaaactgaaaaaacttcatccgtacaaagcgacaaaaagtataattaccctcagtcacacaaattagttaacagtgtatctgtgaatacagattgtgtccagcaacgaggatctccacatgaaagtgtagaggatggcagaaagtcacagtgtgatgatgcttcagagccactcaatagctataaatatgatgcttataaaaatattgacaaaaactcattcaacattatgggtgactggccttcatctgattctttagctcagagggaacacagatcaagaatgccaaagactggtttaagtgagcccaacctagaaattggaacaaatgacaaaatgaatgaaatatccttatctacagcacatgaggcctgttggggcacaagctctcaaaaactaaagacattgggtagctccaatctaggaagttctgaaatgctgctcagtgaaatgacctgtgagagtcagacttgtctaagtaaaaagagtcatgggcaacacacatcgttgcctcttacttttaccaatagtgcaccaactgtttctggagtagtagaaccacaaacgttagctgaatgtcaagagcaaatgcctaagagagaccctggaaaagaagtaggcatgtgcacccagactgaaccacaggattttgctcttttatggaaaatagaaaagaataaaattagcatttcagattctatcaaagtattaacaggaagattagatggatttaagccgaaagttttcaatattaacacaaaatcagacgttcaagaagcaattccatatagagtaatgtatgataaaagcacgtttgttgaagaaagtgagcttaccagtgcagatgaatctgaaaatcttaacattctttgtaaactgtttggatccttttcattagaagccctgaaagacttatatgagaggtgcaataaagatattatttgggccacaagccttttgttggattctgaaactaagttatgtgaggatacagagtttgagaatttccaaaaatcgtgtgatggatcacaaattgggcctttttctctggggttgaatttgaaagaaattattagccaaagaggaactttagagaattctaattctcctgtgccagagtttagccatgggattggtattagtaacgctgactcacagtctacttgtgatgcagaaagaggaaactcagagcaggcggaaatgagagctgtcactcctgaaaaccatgaatcgatgacaagtatatttcccagtgctgctgtgggtctaaagaataataatgacatacttcctaacagccaggaagaacttttatatagcagtaagcagtcctttccaggtattctaaaagctactactcctaaagatatgagtgaaacagaaaaaaacctagtagtcacagagactggagacaacatacattctccttcacatttctctgatatttttaactttgtatctagtacttcaaatcttgaattaaatgaagaaatttattttactgattctcttgaaataaagagaaatgaaaattttccaaaggattatgtgaaattttcagatgaagaagaatttatgaatgaagatgagaaggaaatgaaggaaattctaatggcaggaagtagtttatcagctggagttagtggggaagataaaaccgagatattgaatcccactccagcgatggccaaatctctgaccatagactgtctggaattggcattaccccctgaactggcttttcaacttaatgaattatttggtcctgttggtattgattcagggtctctaacagttgaagattgtgtggttcatatagatctgaatctggcgaaagtgattcatgagaaatggaaagaatctgtaatggagcgacaaagacaagaagaggtgtcttgtggcaagtttatgcaagatccttccttggttggacatactgggcttgataatcctgaacaaaaatcatctcagagaacaggcaaaaaattactgaagactttaacagcatctgaaatgctacctttattggatcattggaatactcaaactaaaaaagtatcactcagagaaataatgtcagaagaaattgccttacaggaaaaacataatttgaaaagggagacccttatgtttgaaaaagattgtgccactaaactaaaggagaagcagctctttaagatatttccagccattaaccaaaattttctggtggacattttcaaggaccacaactattcattagaacacacagtgcaatttcttaactgtgttcttgaaggggaccctgtaaaaacagttgtagcccaagagtttgttcaccaaaatgagaatgtcacatctcatactggccagaagtctaaagagaaaaaggactttgagtacccagactatgatgactacagagcagaggctttccttcaccaacagaagaggatggagtgctacagcaaggccaaagaagcttatcggatagggaaaaaaaatgtcgccaccttttatgcccagcagggtactcttcatgagcagaagatgaaagaagccaatcaccttgctgccatagagatctttgagaaagtcaatgcttcgctgctgccacagaatgttttagacctccatgggctgcatgtggatgaagctctagaacatttgatgagagttttagagaagaagactgaagaatttaagcagaacggtgggaagccctatttgtctgtgattacggggagaggaaaccacagccagggaggagttgctcgcatcaaaccagctgtcattaagtacctcataagccatagcttcaggttctctgaaattaaaccagggtgcttgaaagtcatgctaaagtaaaataaacatccttgaattagaagtatgaaggtttgtaggttaaaattacttttatttgcagtaattcagtcaattctaccctaaagatgtgttttattataaataatattcaattatgaaacaaaaaaattatgatgtttttcaaaatgcaagtgaggtttgattttttactgaatcaaatgcaaatgttacctgttaaagatattacagagaaattttattgattacaaaatatgtaagaaaattatcagctacagttttaaagtttaaaatgctctgattgtttctcagaaaaggttacctttgtattaattgttgtatgacatttagtaatgtcctaaaagtcttttgtgagaggtatttaaagtgctttgagacctgattcatgccccccaaagggtggtattaaaagaggaaaaaggacatagtagtggtagtaaagaaaaaaaggagatctaacaaaaacacttgaatattttttattttcaaaactaaacacataaaatgcttttattttgccatatcctacaggaaggaagacatgcttttgccctttcttctgctttgtatatgaccttgatcttttaccttttgttctgttcttctgtgtgcattttatggaaagaaagttgggtctgagattatattgtaattttatactttctatagacagaaaggttttcagagaaaaagaaatggttaaatatcttccagatgttgctgccttatcgaaatgcttctagaactgtctgtataagtcgtatttcagacagtactaaatacttatattttatttttgaggcatgtaattttaaaactgcagtaggttaaaattctattaaacaaatatagaaaatattttgtttataattggcctggtgtggtggcccacgcctgtaatcccagcactttgggaggccgaggtaggtggatcgcctgaggtcagaagttcaagaccagcctggccaacatggtgaatccccgtctctattaaaaatacaaaaattagctgggtgtggtggcgtgtgcctgtaatcccagctacttgggaggctgaggcaggagaaccgcttaaacctgggaggtggaggttgcagtgacccgagatcgagatcacaccactgcactcagcctgggtgacagagcaagactccgtctcc

SEQ ID NO: 3950 - DNA, 582 bp, Homo sapiens
aggaaacgctgccgaggagtaggcggggcgggcgctttggttccgagggtgcttctgctccgactgcttttcccacgggcgtcatctatagtccggaggacagccccagggcagaggcctctgaactgcaaggtgtggaatatttctggcttctagtccaatgccaagtgtgtgacctgtgagttaattctgcattttagttttggccctacatttatttaaagcctgaatttggggagtatctgcaaagcactgaaggttttggacattgtcttttcctgctgttgaaagagaccctcttcatatatacaacattcaggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaatt

SEQ ID NO: 3951 - DNA, 1288 bp, Homo sapiens
ttttcctgcctgtgagggtggacagatcgcgctcgggtctcggcctcctgagtgccggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgcaaca

SEQ ID NO: 3952 - DNA, 2770 bp, Homo sapiens
gtgcttgcggcaaccctgtaaccgccggtgcgcaagttggaggggcaaggggctgccgtgtcctggtctggaggcggcccaggctgccttggtgattctggcttcgcggcctcatggcttgcggccggtttgcgcaacggcctgcgaaccaccaggcgcgtccccgccggcttgggtccgccccgaagcccagtccctcggcctggcccgctatgccctgcacactggcggagtctggcgtggcgcagcccggcgtggggttcggccccgccaggtggtcagcccttcctcggagtccaggtggctgggggcgcttcggagagtggccaggggcccccaaacccggggccgcagagcagtaccagtccgtggcctgttaggaaccaggctacagagcaggagttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataaggccacgggaagaatctctggcagaaaagaagtacacctctcaagggcagggggacttagacagtgtgctctcccagttgaattttacccatactagtgaggaccttctgcaggcagaggtgacttgtcttgaaggcagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgaggcaaaagagatttcactagcagacctccaggagaattatattgaggcattaaataaattagtgtctgaaaatcaacaactacagaaagatttgatgaataccaaatctcagctggagatttctactcagatgtgcaaaaaacaaaatgacaggatctttaaaccaacacacagcagaacaactgagttcaagaatacagagttcaagccaacccatggccagcacagacatgatggaataaagactgagcactacaaaacagatcttcattctccaagaggacaagcgtcggatagtataaaccccatgtctagggtgctaagccccctgagtcctcaaatcagcccttgcagctccaccaggtctttgacttcctactctctatgtaaaactcattctttgccttcagcgctagatacaaatgaagccaatttttctgacactatgtctgagagtatgaatgaccaagaagagtttatatcttcgtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcactatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctag

SEQ ID NO: 3953 - DNA, 665 bp, Homo sapiens
aaggtggcttgggagggaccagttttcctagatgcaggagacagcgtccatagtttcagttcgaagcaactggtggcaaaaggttagcatttaagatggcagggacagcgcgccatgaccgagagatggcgatccaggccaagaaaaagctcaccacggccaccgaccccattgaaagactccgactgcagtgcctggccaggggctctgctgggatcaaaggacttggcagagtgtttagaattatggatgacgataataatcgaacccttgattttaaagaatttatgaaagggttaaatgattatgctgtggtcatggaaaaagaagaggtggaagaacttttccggaggtttgataaagatggaaatggaacaatagacttcaatgaatttcttctcacattaagacctccaatgtccagagccagaaaagaggtaatcatgcaagcttttagaaagttagacaagactggagatggtgttataacaatcgaagaccttcgtgaagtatataatgcaaaacaccacccaaagtaccagaatggggaatggagtgaggaacaagtatttaggaaatttctggataactttgattcaccctatgacaaagatggattggtgacccctgaggagttcatgaactactatgcaggtgtgagcgca

SEQ ID NO: 3954 - DNA, 582 bp, Homo sapiens
aatgtgctgtgtcacggcagagccgggctgtgtcgcggtgactcagcggggccggtggtttcctaacgcccggggctgaggcagcctggcctgacccagctgtactcgcttaggtgaccagcctcacctagattttgcctctgcacaagggtcagctctttctttgagaatgtttcagaagatctgggtctaaccttgaaacagtgaggtcccaggtcgctggccggctctgcacctgtcgccatccccggctccctgcccagagcaccatcgctacactcgccatcctctgcgtccacctcgccgctcggttcgctgtcccagcccctcccagggccggtgggctcctcagccatgacgcctccccagcagccgccacccctgcgttcagagccgggcacactgggctctgcagcctcatcctacagccccctaggtttgaacggtgtccccgggagcatctgggactttgtttccggcagcttctcccccagcccctcccccatcctgagtgccggccccccatcctcttcgagtgcaagtccaaacggagctgagctggcccgggtcaggcggcagctg

SEQ ID NO: 3955 - DNA, 574 bp, Homo sapiens
gatgactacatcataatgggaaggataaggcgttcctcaaaatggatgccataagtaaagggaagctgaagcctgattaacttcgtcagtgccacaggaagaaacaagagacagaaggaaaaagcactttggatgcccgctgtaattcacagagatctccacggtaggagcgggacgtcagcttctgcggctaaaatctcgtgactgaagcagcacagatcagaaagaacgatttaccagcagctgcagactacataatgaaaaataacaaaagtgcccatgcgcgaggctgtgcaactaaccacccgacgattgcggggaggaggagtaagagtcggctaagcggcgcccagtgtcctactgcgcctgtgcgccggtggcgtgcgcagaggcctctgggtaggtggctcaaccccgcctctcagttgaggactctgaaggctgtttctgtggcgcttcccctgcgaggatggctaccctggttgtaaacaagctcggagcgggagtagacagtggccggcagggcagccgggggacagctgtagtgaaggtgctagagtgtggagtttgtgaa

SEQ ID NO: 3956 - DNA, 637 bp, Homo sapiens
cttatacactgggttccgagccggtcttatcttccgctggaccacctcgccgccctcagggattctggacaaatatggaacgttgggtcggttgccgggtcctcaaaattataaccgccactggatctgcgctgtgcgttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgagagttatgaacaagaaaaatatacccttcaaagagaagttgaactcaagagtcgaatgttagaaagtttgagctgcgaatgtgaagctattaaacaacaacaaaaaatgcacctggagaaattggaagaacaactaagcagaagccatggacaggaagtgaatgaactaaaaactaagatagaaaaactgaaagtggaattagatgaagccaggcttagtgaaaagcagctgaagcaccaagtagatcatcagaaggaactcctctcttgtaaatcagaggaactgcgcgtaatgtctgaacgtgtgcaggaaagcat

SEQ ID NO: 3957 - DNA, 769 bp, Homo sapiens
aggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgagttccaggcactgggctaggcactgggatggtgtggtgagcaaaaactgaccagtcctgccgtggagtttgctgggggagacacatgttactcaaagaatcacactaaggatagcaatttatctcaaagcttcaagttcctgccatctacatgtgcccaggtcaaccaatcaatggctcagacagataagccaacatgcatcccgccggagctgccgaaaatgctgaaggagtttgccaaagccgccattcgggcgcagccgcaggacctcatccagtggggggccgattattttgaggccctgtcccgtggagagacgcctccggtgagagagcggtctgagcgagtcgctttgtgtaactgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgg

SEQ ID NO: 3958 - DNA, 896 bp, Homo sapiens
tgagcgaatgggccggcgactgtggagttagcgtcctcaatgtggacgccctgagctcccattaggagccgctggctgcggcagcaggggactagcgtgagagggattctggacaaatatggaacgttgggtcggttgccgggtcctcaaaattataaccgccactggatctgcgctgtgcgttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgagagttatgaacaagaaaaatatacccttcaaagagaagttgaactcaagagtcgaatgttagaaagtttgagctgcgaatgtgaagctattaaacaacaacaaaaaatgcacctggagaaattggaagaacaactaagcagaagccatggacaggaagtgaatgaactaaaaactaagatagaaaaactgaaagtggaattagatgaagccaggcttagtgaaaagcagctgaagcaccaagtagatcatcagaaggaactcctctcttgtaaatcagaggaactgcgcgtaatgtctgaacgtgtgcaggaaagcatgtcttcagagatgctggctcttcaaattgagctgacagaaatggagagtatgaagaccaccctcaaagaagaagtgaatgaactacaatacagacaagaacagctagaacttcttattactaacctaatgcgccaggtagaccggcttaaagaggaaaaagaggagcgagagaaagaagcagtttcttactataatgccctagagaaagctcgtg

SEQ ID NO: 3959 - DNA, 1088 bp, Homo sapiens
gctacccctggtgacctggcagcggagcccgcgcagggtttgccaggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgagcaatttatctcaaagcttcaagttcctgccatctacatgtgcccaggtcaaccaatcaatggctcagacagataagccaacatgcatcccgccggagctgccgaaaatgctgaaggagtttgccaaagccgccattcgggcgcagccgcaggacctcatccagtggggggccgattattttgaggccctgtcccgtggagagacgcctccggtgagagagcggtctgagcgagtcgctttgtgtaactgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccacaatggtgggttgccccgaatcccattcagcaccttccagtttctctacacgtatattgccgaagtggatggggagatctgtgcatcacatgtcagcaggatgctaaactacattgaacaggaagtaattggtcctgatggtttaatcacggtgaatgactttacccaaaaccccagggtttggctggagtaacagcacaattttggcaattttaaaggaagatacagaggtgattgtacttcagaatgataaacccatataccacctaaaatcaattttcttgtacaactggtacacactaataaacaaacatgtgagatcagaaa

SEQ ID NO: 3960 - DNA, 2844 bp, Homo sapiens
atgaatttcctccgcggggtaatggggggtcagagtgccggaccccagcacacagaagccgagacggtgagaggagcagcggacccgaaggtcacctccagctgtggacttaaatttagacatagttttcgtttagtcaagcacattttataccatgttactataaatgtgtattcagattctgaaataataggttatgctttggacacactatataatataatatctaatgaagaagaagaagaagtagaagaaaattccacaagacagagtgaagatttgggaagccaatttacagaaattttcattaagcagcaggaaaatgtcactcttctgttatctttattggaggagtttgatttccatgtccgctggcctggtgtgaagcttcttacttctcttttaaaacaactagggcctcaggtgcaacaaattattttagtcagtcctatgggtgtttcaagattgatggacttactagcggattccagggaagttatacgtaatgatggcgtcttactactgcaggcactaacaagaagcaatggtgcaatccagaaaattgttgcttttgaaaatgctttcgagagactactggacattatttcagaggaggggaacagtgatggaggtatagtagttgaagattgtttgattttgctccaaaacttattaaaaaacaacaactccaatcaaaatttttttaaagaaggctcatatattcaacgtatgaaaccttggtttgaagttggagatgaaaattctggctggtctgcacagaaagtgaccaatctacatctaatgctacagcttgttcgtgtattggtatctcccaccaaccctcctggtgctaccagtagctgccagaaggctatgttccagtgtgggttattgcagcagctttgtactatcctaatggctactggggttcctgctgatatcctgactgagaccataaatactgtatcagaagttattcgaggctgccaagtaaaccaagactactttgcatctgtaaatgcaccttcaaacccaccaagaccggcaattgtagtacttctcatgtccatggttaatgaaaggcagccatttgttttgcgctgtgctgttctctattgtttccagtgtttcttgtataaaaaccaaaaaggacaaggagaaatcgtgtcaacacttttaccttctaccattgatgcaacaggtaattcagtttcagctggccagttattatgtggaggtttgttttctactgattcactttcaaactggtgtgctgctgtggcccttgcccatgcgttgcaagaaaatgccacccagaaagaacagttgctcagggttcaacttgctacaagtattggcaaccctccagtttctttacttcaacagtgcaccaatattctttcacagggaagcaaaatacaaacaagagttggattattaatgttgctttgtacctggctaagcaattgtcccattgcagtaacgcattttcttcacaattcagccaatgttccatttcttacaggacaaattgcagaaaatcttggagaagaagagcagttggtccaaggcttatgtgcccttttgttgggcatttcgatttatttcaatgataactcacttgagagctacatgaaagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtgttataactaaggctatttataagtccagtgaagaagataaaaaagaagaagaggtgaaaaaaacattagaacagcatgacaatattgtgactcactacaaaaatatgattcgagagcaggatctccaacttgaggaattaaggcagcaggtttctacattaaaatgtcaaaatgaacagctccagacggcagtcacacagcaagtatcacagatccagcagcacaaagaccagtataatcttcttaaaatacagctaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatgaaatcttcccaaacatctggcacaaatgaacagtcttcagcaatagtttcagctagagattctgaacaagttgcagaattaaaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctag

SEQ ID NO: 3961 - DNA, 1642 bp, Homo sapiens
agagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactt

SEQ ID NO: 3962 - DNA, 1339 bp, Homo sapiens
ctgtggctctgtggtaggggaatgccaccaactccctgaggagcagccgtgtggtatgattgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 3963 - DNA, 913 bp, Homo sapiens; identical to SEQ ID NO: 3945

SEQ ID NO: 3964 - DNA, 574 bp, Homo sapiens
atctgtacaagggagatctagaggtctggcccaaagggaaacttttgctgccaccactttcaaagctttcgttaaaaaaacaaaagggagggggaaggtggagaaacaaccaaaattctgtcattccaaataaatctaagtgaactattgattttgatacaaagcaacagcctctgccacactgaagaagtgagctttaagcagagactagaagggtatggcatcacagctgcaagtgttttcgcccccatcagtgtcgtcgagtgccttctgcagtgcgaagaaactgaaaatagagccctctggctgggatgtttcaggacagagtagcaacgacaaatattatacccacagcaaaaccctcccagccacacaagggcaagccaactcctctcaccaggtagcaaatttcaacatccctgcttacgaccagggcctcctcctcccagctcctgcagtggagcatattgttgtaacagccgctgatagctcgggcagtgctgctacatcaaccttccaaagcagccagaccctgactcacagaagcaacgtttctttgcttgagccatatcaa

SEQ ID NO: 3965 - DNA, 605 bp, Homo sapiens
agctttgaaggtcttgcggtggtgcgtggcgggcaggaacccacaattccaaatacaaacggtcggcgcgagaagcgcttctgggcgcaggcgcctggctgtagcgactggttgcgggaggctggactctggtgactgtgtatggttgcatatgctccgttttcctctccctgtcgtgctgggcctttgaaaccggcttctttgctggtggctgcttggtgaaaaattagacgatttcaagaattggagctgaatctgatgttaagtaatggcaacaggtgacttaaaaagaagcttacggaacctagaacaggtgctccgcttgctaaattatcctgaagaggtggactgtgtaggtttgataaagggagacccagcagcatctttgcccatcatcagctattcttttacctcatactcaccttatgtaacagaacttataatggaatccaatgtagagctcatagcaaaaaatgacttgcgctttatagatgctgtctataagcttcttcgtgatcaatttaattataaaccaattttgacaaaaaagcagtttatccaatgtgggtttgcagaatggaaaatccaaattgtttgtgatattt

SEQ ID NO: 3966 - DNA, 532 bp, Homo sapiens
atatttgatggttttgttgctttgctcgggagttctcgggagtaatttaatgccgaaggtcgctgcctagtggaaataatataatacgtcattaatatggcgccaaaagattgggttctcgatctgtagcgaggagggagggaggcagccgctgagcgcagcgttactatcccaccagtaacttgggcattgccggggcgggggccggaggaggaggagaggatgatttttggatcctgagaattgatctatgttggatcagtaagttttattatgattttttttttcaaatttggggggctgaagacttagagctatttcttcttttggatttgcgaagaacatgcggttttcagttcatagccctgatgaagcaagttactctgctctcctaataaatgcaagaaaatgaccttggagggcctttttaattacacatagaagtgacaatttgctgcctgctgtttcccggggagatcatgaaacgaggtcgccttcccagcagcagtgaggattctgacgacaatggcag

SEQ ID NO: 3967 - DNA, 1697 bp, Homo sapiens
gcagaagtccggggctggcaagcgcttcctgcgcagcgcctaggcgacctggagtttgtgacgctgtgatggtctagaggctggagattcaagatctgggtgccatcattttctggttctgttgatgaccctcttccagtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 3968 - DNA, 653 bp, Homo sapiens
tttcctgccgtaagtatacagtgcctccgggtcgcggtcattttgagcccctgtctggatgacttcttgcggctgttctacccctccccctccccgcgtcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctggg

SEQ ID NO: 3969 - DNA, 1305 bp, Homo sapiens
aaaagcgaccttttctgagcgcgtttgcctgttgagtggtagcctttcccctcaaccagcaatggaggagcagccccagatgcaagacgccgacgagcccgcggactccggaggggaaggccgggcaggcgggccaccgcaggtcgccggcgcccaggcggcgtgcagcgaggaccgcatgaccctgctcctcaggctgagagcacagacaaaacaacaactcttagaatataaatcaatggttgatgcaagtgaagaaaaaactccagaacaaattatgcaagaaaagcaaatcgaagctaaaattgaagacctggaaaatgaaattgaagaggtaaaagttgcttttgagataaaaaagcttgcattagacagtgtgctcatggataacatgaaacacctattagagctaaataaattaataatgaaatcacagcaggaatcttgggatttagaggaaaaactgcttgatattagaaagaagagattgcaattaaaacaagcttcagaaagtaagcttttagaaatacagactgaaaagaacaaacagaagattgatttggacagtatggaaaactcagagaggataaagatcatacgacaaaacctacagatggagataaaaattactactgttattcaacatgtgttccagaaccttattttggggagtaaagtcaattgggcagaggatcctgcccttaaggaaattgttctgcagcttgagaagaatgttgacatgatgtaataagaattcatttctgacatattttacatttctggcaatctcaactcttatttggaatacttctgtgcatttgtctgtccaccgtaattttagaaaagcatatccataacgtttacagttgtagtacagttgtggttagttatttgtagtgggattgaaagtaatttttttctttttatatttctatatttagtttgtttttttgttgttgttgttttttgagatggagtctcgctttgttgcccagactggagggcagtggcgcgatctcggctcactgcaacctctgcctcccgggttcaagcagttctgcctcagcctcccaagtagctgtgactaaaggtgcacgccgccatgcccagctaattttttgtattttagtagagacggggtttcaccgtgttgcccaggctgctctcagaactcctgagctcaggcagtccaccgcctcggcctaccgaagtgctaggattacagacgtaagccaccgagcctggtctagtttgcattttttttctatcagttttataagttaagaaataaaaggaattaatgtt

SEQ ID NO: 3970 - DNA, 2578 bp, Homo sapiens
cttttgtctctcagctattttttgttccctatgtttgtaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagccctgtcaatgaagacaatcaagatggtgtcacgcactctgatggtgctggaaatctagatgaggaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggtttccctgctcctcctaaacaattggacatgggagatgaagtttacgatgatgtggatacctctgatttccctgtttcatcagcagagatgagtcaaggaactaatgttggaaaagctaagacagaagaaaaggaccttaagaagctaaaaaagcaggaaaaagaagaaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactagcactcaactttggtcattctgctgtgttcattaggtgccaatgtgaagtctggattttaattggcatgttattgggtatcaagaaaattaatgcacaaaaccacttattatcatttgttatgaaatcccaattatctttacaaagtgtttaaagtttga

SEQ ID NO: 3971 - DNA, 850 bp, Homo sapiens
agggaccttatttaggttgcgcaggcgcccgctggccatttcgtcttagccacgcagaagtcgcgtgtctaggtgagtcgcggtgggtcctcgcttgcagttcagcgaccacggtgggtaccgtttttgcgaggattgtttgtccccatatctctgggagggccacggggaccttggcgagctgcaggctgccgtcgagagccgcgagtggttcgctgaatctcggcaccgccgctgaggcctgcaggccgcgccgactctattgtgtgagaagtcggaggaggcggagcggaagcggccgccgccatttcctttcctctacgctggctctcggcccgggcccccacggttcggggcgccgacagctgttgctcaggacagctttgggggtccggtcgccggacgaggaggtgttggagtcgccgggtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttctt

SEQ ID NO: 3972 - DNA, 552 bp, Homo sapiens
ctcgcgggaactgcattcaaatatcccaggcgcttactcgagagctagctgagcgaatgggccggcgactgtggagttagcgtcctcaatgtggacgccctgagctcccattaggagccgctggctgcggcagcaggggactagcgtgagagaatggaacctagtatataaggcattcaagaaatactcgttcagtgaatgactacattgacttgagacatgggggaacatcttgcaatgacctggtgccctttgaaggcaaagttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgagagttatgaacaagaaaaatatacccttcaaagagaagttgaactcaagagtcgaatgttagaaagtttgagctgcgaatgtgaagctattaaacaacaacaaaaaa

SEQ ID NO: 3973 - DNA, 4273 bp, Homo sapiens
atgacggccggcgcgagtattttccacataaggtggctgtcgtttttctcctggcgtctgtggaggcgagtggtctgcgggcagcagctcccagaggcagccttggaattccagctcggactgggcgggaaggcgcaggcggcccaggtcgccgacacgctcacgcaccctccctgcctggccgcgcctctgcgaccaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaaagacttgcttgaaagcctgtgctgaagttagtcagtggaccaggctatgtgaactcaccatccctttggctattgagaattttctcagagaatcttctgaccagcccccaactatacctgtagaaatactacagctagagaaaaagcttagtgagcctgttagagtgcataatgatgataaactccgcaggcagaagctcaagcaacagaaggctgatggagttgggcctccccttactaagggaaaggcaaagagcaaggtccacacacaggaaacatctgaagggttggattcttcatccaagagtctggaactgaaagtggcattctcaaagctcacagtacaggaagaaccagctactaccaacagagagccttctcacatcagaaaagcaaaagcctccgaccttccacctctggagcatgtgtttgcagaagggctttacttcactctggcagatattgtgctcttgccctgtatccatcatttcttggtaattatcagcaggaaattttctgagaagctggtagaatttccattgctagcctcttggtaccagaggattcaggaagtgccaggagtaaaaacagcagcttctaagtgtgggatccaatttctccatttaccaaagttgttgacaacctcaactgaacagcatccaaacttatgtgaagtcccaggtgtagaagagcaaagcgatcctttatttataggaggaccaagaccaaccatggccaagttaatggaaaagggcattgaagtgatgttttctccccacccttgccctacttggactcttgattggaatgttctccctgcagcagtcagcccaaaggaaggtaaaatgtccagtgatcgagctttgaggaagcagcaacagttgaacaaccttgtctatgtggtaacaaatcaggccaaacctggtgacagaattgtggatttctgcagcggtgggggccatgttggaattgtccttgctcacatgctgccatcatgtcaggttacattaatagaaaacaaggaattatcattaattcgtgctaagaagagaagtgatgaactgggtttaagcaacatttggttcattcaagcaaatatggaatattttactgggatgtttaatattggagtagcattgcatgcttgtggagtggcaacagacatggtgattgagcactgtatcaaaacacgggcttccttcgtcacatgcccttgctgttatggtttcattcagaacacctcaaagttcaattttccaaaaagtgaacaattcaagaaaactttatcatacaaggaacacatgattctgtgcagatttgcagaccagacagctgtccagctcccaccccaacgaaggctcataggaaaacagtgcatgtgcttggtggatctggatcgagcaagagctgcagaagaatgtggatactccgttcaagtgatatccatggagccagagagctgctctcccaaaaataacatgattgtgggagtccccatttaaaatgagatattcacatttgatattttgccatccgtcttcacgttggatgcccagtggcattcaggaggttcttggcataactaggaaacagcattagccatcttgaacctattgtgctcaggaaggaaagcaacagggaaatcttggaagtaaaggctccctgcaaagcatcacaaatgctttacaatgtgtgattaaaggactgctggtttttatagtgagaatcccctgaagtctcagctgccaaaagaataatactagtggaggttccatcacaggaataacaatttccttctcacttcacaagctcctctgatcttgccaatgtgatgtttaattcaaaacagcgcacttacagcctttattttatacttatttagatattcacatgggaactgaaagtagactcagtggagttttttgttttttatatttttaacaattgtactttttctatcactttaaaaaaatctagtcaggtaattatagtacagttatttttaagctggggttagttgaacttgtatagcatttaatatactccttttaaatatatttctgccaggcatggtggctcatgcctataatcccagcactttgagaggccaaggtgggaggatcatttgagcccaggatatcgagaccagcctgcactacaaaaaaatccaaaaaatgaggtgggaggatcacttgagcccaggaagtcaaggctgcagtgagccttgatagcgccactgcactcctgcctgggaaaatgagacccagactcaaaataaatcaatgaatgaattaataaacaaataaataaataaataaatttcccataaattaccaaatgagattgtcactggttcaaattattaaataattgccataaatttcctattacgggaatgtggaatttggacatacattttaacaataagtacattgattaatacatttaagtttataagtaattattgaggatccagtattttcaagaccttggcctagtttcttttcaattcaaagatgagttgcaaaagacataatgttttgcctatggaagtagatcatctagaagaaaaagattaaagaattagttaagcttttttttttttttttttttgagacagagtttcactcttgttgcccaggctggaattcagtggctcgatcttggctcaccacaacctctgcattctcctgcctcagcctcccgagtagctaggattataggcacctgccaccatgcccggctaattttgtttgtaattttagtagagatggggtttctccatgttggccaggctggtttcgaactcctgacctcaggtgatctacccgcctcagcctcccaaagtgctgaaattacaggcgtgagccacctcacctggccatgttctttatggaatactacaatgtgttgtcacaggatttgttattcagatgtcaatcatttttatttatatatttctgggtaaaacttattagtggtgtgaggagtgcagaatatggaagcttacctaaattctttttctgccagccaacattttaaaagacaaatgatgcatcctttctcaatgctgctaattctttaaattttacatgtcccaatttattccatttgagatttattttaatgttttcaacccctgtgtaacatgtatcatgaggagaaagcactatcattgatcatcactatggattaaaatataggaatattttacagggcagtatgggtgggggtgggagacatattggaatcgtgttttctgggataaaatttttaaaaagaattaatcattagccctgagtattttagtcatttgtgcctatagaaaacaacatgctcttttattgtggactttcttcttttaagtgaggtttaatttatatacaatacaataacagatttttaagtattcatttgagatgttttgacaactgtatatatacatgtaaccatcactggaatcagatatagaatattccccttaaatattgtcaggtaaacacattgagaatattttttccagtctgtggcttacctacttattttcataatgaatgttttacttgtgatgaagatttaacttacccttttactttaatgattaatattttctgtgttctttctaataaattttacgaactctgaggttataa

SEQ ID NO: 3974 - DNA, 913 bp, Homo sapiens
ttccaaatacaaacggtcggcgcgagaagcgcttctgggcgcaggcgcctggctgtagcgactggttgcgggaggctggactctggtgactgtgtatggttgcatatgctccgttttcctctccctgtcgtgctgggcctttgaaaccggcttctttgctggtggctgcttgaagcatcaagtgtacctgatttgtgaacctatcttgcttcagttggtttcctcctaaatattaggcagatgggattggctggtctgtgctctgctaggtgaaaaattagacgatttcaagaattggagctgaatctgatgttaagtaatggcaacaggtgacttaaaaagaagcttacggaacctagaacaggtgctccgcttgctaaattatcctgaagaggtggactgtgtaggtttgataaagggagacccagcagcatctttgcccatcatcagctattcttttacctcatactcaccttatgtaacagaacttataatggaatccaatgtagagctcatagcaaaaaatgacttgcgctttatagatgctgtctataagcttcttcgtgatcaatttaattataaaccaattttgacaaaaaagcagtttatccaatgtgggtttgcagaatggaaaatccaaattgtttgtgatattttgaattgtgtgatgaaaaagcacaaggaattaagcagtcttcagaagattccatcacaacaaagaaagaaaatcagttctggtaagtcagaacctcctttgggcaatgagaaaatatctgcagaggctgttggcgttgatatcagtggcaggtttatgacctcaggaaagaagaaagctgtggtgattcgtcacttgtataatgaagataatgttgacatttctgaggatacattaagtccaataacagatgttaat

SEQ ID NO: 3975 - DNA, 560 bp, Homo sapiens
gcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagttattcttgtgtttgctccctcagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaac

SEQ ID NO: 3976 - DNA, 945 bp, Homo sapiens
ctgtggctctgtggtaggggaatgccaccaactccctgaggagcagccgtgtggtatgattggtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 3977 - DNA, 2044 bp, Homo sapiens
ttattagcccctcctcctcgctcggtccaggaccggctctgcgggcgccgccaggcccagaccaagctactatcagaagttgaattctaataattagctattttataaaggtaacgagaaaaaatacactatgtctgatgaagtttttagcaccactttggcatatacaaagagtccaaaagttaccaaaagaactactttccaggatgagctaataagagcaattacagctcgctcagccagacaaaggagttctgaatactcagatgactttgacagtgatgagattgtttctttaggtgatttttctgacacttcagcagatgaaaattcagttaataaaaaaatgaatgactttcatatatcagatgatgaagaaaagaatccttcaaaactattgtttttgaaaaccaataaatcaaacggtaacataaccaaagatgagccagtgtgtgccatcaaaaatgaagaggaaatggcacctgatgggtgtgaagacattgttgtaaaatctttctctgaatctcaaaataaggatgaggaatttgaaaaagacaaaataaaaatgaaacctaaacccagaattctttcaattaaaagcacatcttcagcagaaaacaacagccttgacacagatgatcactttaaaccatcacctcggccaaggagtatgttgaaaaagaaaagtcacatggaggagaaggatggactagaagataaagaaactgccctcagtgaagaattggagttacattctgcaccttcttcccttccaacgccgaatggcatacaattagaagctgagaaaaaagcattctctgaaaaccttgatcctgaggattcatgcttaacaagtctagcatcatcatcacttaaacaaattcttggagattctttttcaccaggatctgagggaaacgcatctggaaaagcagaccatgtgactactgcagttgagaaatccaaggaaagtcaagtgactgctgatgaccttgaagaagaaaaggcaaaagcggaactgattatggatgatgacagaacagttgatccactactatctaaatctcagagtatcttaatatctaccagtgcaacagcatcttcaaagaaaacaattgaagatagaaatataaagaataaaaagtcaacaaataatagagcatccagtgcatctgccagattaatgacctctgagtttttgaagaaatctagttctaaaaggagaactccatcgacaactacctcttctcactatttagggactttaaaagtcttggaccaaaaaccttcacagaaacagagcatagaacctgatagagcagataacataagggcagctgtttatcaggagtggttagaaaagaaaaatgtgtatttacatgaaatgcacagaataaaaagaattgaaagtgaaaacttaaggatccaaaatgaacagaaaaaagctgctaaaagagaagaagcattagcatcatttgaggcctggaaggctatgaaagaaaaggaagcaaagaaaatagctgccaaaaagaggcttgaagaaaaaaacaagaagaaaactgaagaagaaaatgctgcaagaaaaggagaagcactacaagcttttgaaaaatggaaagagaaaaagatggaatatcttaaagagaaaaatagaaaggagagagaatatgaaagagcaaagaaacagaaagaggaggaaactgttgccgagaaaaagaaagataatttaactgctgttgagaaatggaatgaaaaaaaggaagcttttttcaagcaaaaggaaaaagaaaaaataaatgagaaaagaaaggaagaactgaaaagagctgagaaaaaagataaagataaacaagctattaatgaatatgaaaaatggctggaaaataaggaaaaacaagaaagaattgaacgaaaacagaagaaacgtcattcctttcttgaaagtgaggcacttcctccgtggagccctccaagcagaactgtgttcgcaaaagtgttttgataattctagttcttacattatttggttatttatcggtttgcc

SEQ ID NO: 3978 - DNA, 690 bp, Homo sapiens
acgcctggtgaatggacgcactcttaccaattctgctctgggagatgcagcggtaacctaccgagcgcagaggccggcgcgcacccgtggagcccgcgctcgcgatccctcctcgtgccagggccccagggcagtcaaggcctgccgaccgttaggcgggtcaaggggtacacagggtgcgaattcgttaggcaaaagctgggtacaggcgcgagccacaggcacggaaacctcgcgccgaccggggccctaggcccgacgacggcaggtcggccaggagcgcgccggtaagagcctgggggcaaggggtagaaagacgcccacctcatcacaacccagagctcgggactcctatacagtcccatagggaacaggcggccgccattcccctcccccacgctggcggtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaag

SEQ ID NO: 3979 - DNA, 4113 bp, Homo sapiens
gcactctagcctgggtgacagagtgagactccgtctcaaaaatatgcactgctgatctgttaatagagttatggaatcattgagctaaatgaagtttgcatatgaacaaatgaatgaattggctacaaattgatatgatttatagaaactctgttcgaaagtattggggacttgatgtttaaacattattttagtaaaaattcctataaccatgtatcatctgtaggattgatttggtacctatttctcctgttggaccatgagttcctccagagcagagcttttgtcttagactattttatttctatttctatttcttttttttctttctttttttttttttttttgagacagtctcttgctctgtcacccaggctggaatgcagtggcatgatctcggctcactgcaacctctgcctgcagggttcaaatgattctcctgcttcagcctccccagtagctgggacaggcgcatgccaccgtacccggctaatttttgtatctttagtagagacagggtgttggtcagactggtcttgaactcctgaccttgtgatccgcccacctcggcctcccaaagtgctgggattacagatgtgagccaccatgcccagcctagactgttttatttcttaagcactgttttcctaatttcttaagcactgagctcccttaaaattcagcaaatgtttgttaatgatgatgaatattttactaatttctttaaaaacatattttcaattgaagttgcaaaaccttggaacctcttaatttatatcttgcataaatgacaatttgttaaagttaagatacattgctgtggaaatctatgtatttctttactgcaaaatagtattaaaggaaactaaatgaatttcaagaatatgagctttataatttaatttttaggattcgctaaatattgtaatggatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaagatattaaactatttcagcaccagaaaaaactcaatgggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaacatgaaacc

SEQ ID NO: 3980 - DNA, 2771 bp, Homo sapiens
gaactgggccaagcgcccccggaggcgctaagcttgcgccctgaggcggtttccgttcccggacgtttggactctgtcctggagaaggggaaggaaaaagtaagacgtagaagtacactgagacttcgtcacacataaaacaagcacgacaaagaaagagggcgcgaagggactcctggaagaaattgagtctacatttaagatcaccctaaaagtagtgacggcctcttcattactccaaaccccagatttaagtcggtaggacgtcttcgcgttgacttgtggggaatgtagtttcgatgctgccggcgcgttttgtttgcgacagaaactacaacccccaggggccaccgcgacgttgcctgtgggtgcccgcgaaccaacggttagcggtggcaggggctgactgagagcgtctgcttgataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttctggaagcctatgggaactagtacaa

SEQ ID NO: 3981 - DNA, 1068 bp, Homo sapiens
atgaccggctccgcggccgacactcaccgctgcccccaccccaaaggcgccaaaggcacccggtcccggagcagccacgcgcggcccgtgagcctcgccaccagcgggggctcagaggaggaggacaaagacggcggggtgctgttccacgtcaacaagagcggcttccccatcgacagccacacctgggagcgcatgtggatgcacgtggccaaggtgcaccctaaggggggagaaatggtgggcgccatcaggaacgccgccttcttggcaaagccttcaataccccaggtcccaaactacaggctgtcgatgacgatcccagactggctccaggcgatccagaattacatgaagaccctacaatataatcacacagggacccagttctttgaaattaggaaaatgagaccgctgagtgggttaatggaaacagcaaaagaaatgacccgagagtccttgcctatcaaatgccttgaagctgtcatcctgggcatctacttaaccaatgggcagccttccattgagcggttccccatcagctttaaaacctacttctcaggaaactactttcaccacgttgtgctggggatttactgcaatggccgctatggctcattgggcatgagccgcagggctgagctgatggacaagccattgacttttcggactctgagtgacctcatctttgactttgaggactcttacaagaaatacctgcacacagtcaagaaggtcaagattgggctgtacgtcccccatgagcctcatagcttccagcccattgagtggaagcagctggtcctcaacgtctcaaagatgctgagggctgacataaggaaggagctggagaaatatgccagggacatgagaatgaagatcctgaaacctgcaagtgcccactctccgacccaagtgagaagccggggaaaatccctgtcccccagaaggagacaggcaagccccccgaggaggctcggccggcgagagaagtcgcctgcactgcctgaaaagaaggtggctgatctgagcactctgaatgaagtgggctatcaaatccgaatttag

SEQ ID NO: 3982 - DNA, 563 bp, Homo sapiens
gtcccaaccgccgacgccgatgcggagctgagctggctttcctccagggctctggactccctgctgagcaagagagaaagaggcccgcccttccaccaggacgcctgaccctggggtccttcccaaacccgggtctcttccgactccgggcccaacagtttgtgcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagaagtaaaataagtgaacttacaactgaagttaataaacttcagaagggaatagaaatgtacaatcaagagaattc

SEQ ID NO: 3983 - DNA, 2287 bp, Homo sapiens
ctaagcctcgattgaaggagcacatcccttccattgaagctgcagaggagcagctgccaccctgtgcacccacacttgcttaagggtctagctggataacaaaaggaggcccagaatcggtggagcttggagatgagcgaagcagtcctgcaccaggttctgaactaattagctggtggaggggacaatacgagtttaaacagcggctctgggtgcctaagattctacattttatacagacatccttggttccagagggggctgagcaggggggtccgaggtgagtctgtgagcatgtgcaagtctgtaccagcttgtgaaggacatgccatgtcccctgagtactcatagaaagacaccaacatgacaaaggtagtttggctttatacctagaaaaggcccccaggtcacaagcttctcaggactttgtgggattttccaggtgggccctgaggggtggcactaaagcagactcaagaggagtctggggtggaggtgggttgcttggaaaagagggcggaggaaaaagctaaatgcagtcagccaggaggggctgcccaggacccaagtcaaagagaagaatttgaaagctttggaagcaagtgctgttgtgggggctgcatagcccagggctggctgaagctgatccaccacgctctgccactctggctccacagagcacagagcttgtccctaaagcttcctgtagctgaccatgagaaatggtcatgcagccacacacacttccccagcccctctctctgctctaccagcctgtcacccacgtttgggccacgagaagtcactgctctgtaagtagttgtgactgcagtgggtctttttggtcacccctgtcctgggcttacttcaggtggaagcttgaagctggatggcagctgagccagcagaccgattctgacacttacagatgaggaaactaaggcagagatggtaggacctgcccagtgttacagctgagtaaagtggcagagctgggaccagaacccaggtttgctgactccctgtctagcactccttccttcaggctatgtagtccctgagcagaatgtggcatctcaggttgtgagaaatgatggagttcaaatttataacaaggaaggcttctaaagggctaggaaggcttctaaagggctggggctcacctgggacctgtccagtcttatttgaggagccacacccttagaggtcattctggaacagacctgggaatccatggaatgtgctggaaagagccctgggctgggatctggtccagttctggtgctcacatgctatgtggtcttaagcaagccccttcccctctctggtgctccaattactaaatgcaaaatgagggtttggccccagtgcttttccagctccgatgctccatggcccagttctaacagagagccctgatcttgaagtggactcactcccctgggctggagcctggtaaagataggaaaagggtacacagtcccatcccggtcactctgccttcctgaagtgctctccttgggtcctctgcaggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctc

SEQ ID NO: 3984 - DNA, 224 bp, Homo sapiens
tcgggttctgtggacacaggcaggaagcttaagaggctctgctgagcagggacctggggaagaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcacca

SEQ ID NO: 3985 - DNA, 1094 bp, Homo sapiens
aagcaagcctcttataggcagcataagttgagtgtttttaaaaatccatttaactactttgcctttttattggagaacttaatccacttacgttcagggttatcattcataggctgctgatactttggctgtgaggcaaaaaaggagaatttatgatatcaccaatgtcttagagggaattgacttgattgaaaaaaagtcaaaaaacagtatccagtggaaaggtgtaggtgctggctgtaatactaaagaagtcatagatagattaagatatcttaaagctgaaattgaagatctagaactgaaggaaagagaacttgatcagcagaagttgtggctacagcaaagcatcaaaaatgtgatggacgattccattaataatagattttcctatgtaactcatgaagacatctgtaattgctttaatggtgatacacttttggccattcaggcaccttctggtacacaactggaggtacccattccagaaatgggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcagcaggatctattagtggagatatcattgatgagttaatgtcttctgacgtgtttcctctcttaaggctttctcctaccccggcagatgactacaactttaatttagatgataacgaaggagtttgtgatctgtttgatgtccagatactaaattattagattccatggaaacttgggactgttatctacctctaactgtgtaacattttagacttcttaataacctaaatatttaaaataatgaatgtaacaccttttttagttcactgattctgaagtgttcttccctaatactttctttacttcacaaaacttcaaccataaaaacaaaggg

SEQ ID NO: 3986 - DNA, 876 bp, Homo sapiens
gttgtcgaccctgttcttcgggagaccctaccaggttccgttcacctgccccgcccccgactcagcgaggcctcctctggccgggcgtcctcacggcgctccataaacataaatgagcatattctgatgtactctttggatctgaactcatcttcacagatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctg

SEQ ID NO: 3987 - DNA, 1972 bp, Homo sapiens
ggcagagaccgcatattccggaggggctggctccaggccacgcgagccggagctggagacatttccagagccttgaggatggcaccggccctcgcacgctcaactcctgctcctcctcttcgcaatgagtaaacgacgcagattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagaccgtaggagaattcaacatataatttcttaataaatactgtttcttttaaaacaaa

SEQ ID NO: 3988 - DNA, 579 bp, Homo sapiens
acttggaaaggaggagcagcctcgggtgggactgagcggatcttctggttctagagcggcctctgattggacaaacttgacttagggaccgtgtctgtctgcgatggggcttggtaaagaaacagatacagagtgttcgctgtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcggacaaatatggtcttggaaccaggcttcagcgacca

SEQ ID NO: 3989 - DNA, 1697 bp, Homo sapiens
tttgctcagcccgcctgcgccgcttgggacgcctctgcctttccctccctcccttccccgacggcttctggcggccaagtggatgtggcgggtgatcgagccaccctgcccaggggcgcccagcactgagaatggcaaatcggttcattggaaacttggagctgataaggaagtctgggtatgggtgatgggcgaacaccatctagataaaccctatgatgtgctctgtaatgaaattattgctgagagggcccggctgaaagcagaacaggaggcagaagagcccagaaaaactcactctgaagaattcaccaatagcttgaaaacaaaatcacagtaccatgatctgcaggctccggataaccagcagactaaagacatctggaagaaagtggcagaaaaggaggaactggagcaaggatcgaggccagcaccaaccctggaagaagagaaaatccgatcactctccagttcttcaagaaatattcaacaaatgttggcagattcaatcaatcgtatgaaggcatatgcatttcaccagaagaaagaatctatgaagaaaaaacaagatgaagaaataaatcaaatagaagaagagagaacgaagcagatttgtaagagctggaaagaagactcggaatggcaggcatctctgcgaaaatccaaagcagctgatgagaagagacgctccttggctaaacaagcacgagaagactacaagaggttatccctcggggcccagaaaggaagaggcggtgagaggctgcaaagccccttgcgtgttccgcagaaaccagaaagacctccccttccacccaagcctcagttcctaaactcaggggcatatcctcaaaaacctcttagaaatcagggagtggtgaggacactgtccagctctgcccaagaggacatcatccggtggtttaaagaggagcagctaccacttcgagcgggctaccagaaaacctcagacaccatagccccctggttccatggaattctcacactcaagaaagcaaatgaacttcttctgagcacaggcatgcccggcagttttctcatccgagtcagtgaaaggatcaaaggctatgccctgtcctatctgtcggaggacggctgtaaacatttcctcatcgatgcctctgcagacgcctacagcttcctgggcgtggaccagctacagcatgccaccttggcggatttggtggaatatcacaaggaggaacccatcacttccctggggaaggagctccttctctatccctgtggtcagcaggaccagctgcctgactacctggagctgtttgagtgacagcctccatcagggtcatcctacagcctccaagcgggctttcccctggacaaatgccactgcaacatttatgtgtgaagccaaaatcaccctgcagcagagccaatactgatcaactgaaagtaaagtatccatggagtcctcattgacacctcttttctgcacaaatactggaattcaatgtcaagagaaaatgacctctgctcaaaagggagaagagtctcaatttcagcaagtacctgtcatgaagggtatgaccttaatgatgtacataaaataaaacaaatgaagaaatggaaaacttttagaaattaaggtgtacttgaaaacgaatatctatcatatgacccctgcactccctctgtatcatctcaggaggtttcag

SEQ ID NO: 3990 - DNA, 540 bp, Homo sapiens
gaaatctccatgcatccgagctcagtggaggaatgtttattgagtccatagaaatttgagcagggcatatctctaggggtttatgacaggctgttttcttttctcagtgtggggatgaattgctccattatcatctaaattggaagaaaccaacatgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcagtgagcactcccagtgaagctggaagccaagactcaggcgatctggggccattaacaaggaccctgcagtgggacacagacccctcagtgctccagctgcagtcagactcagaacttgggtatatgtctgc

SEQ ID NO: 3991 - DNA, 3409 bp, Homo sapiens
gagctgaggcccgcgtcgatcctgggttggaggaggtggcggccgctgaggctgcggcgtgaagacggcgggcatggtggggcgggagaaagagctctctatacactttgttcccgggagctgtcggctggtggaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcagccccatgttatagtacattgtgcagcagagagaagaccagatgttgtagaaaatcagccagatgctgcctctcaacttaatgtggatgcttctgggaatttagcaaaggaagcagctgctgttggagcatttctcatctacattagctcagattatgtatttgatggaacaaatccaccttacagagaggaagacataccagctcccctaaatttgtatggcaaaacaaaattagatggagaaaaggctgtcctggagaacaatctaggagctgctgttttgaggattcctattctgtatggggaagttgaaaagctcgaagaaagtgctgtgactgttatgtttgataaagtgcagttcagcaacaagtcagcaaacatggatcactggcagcagaggttccccacacatgtcaaagatgtggccactgtgtgccggcagctagcagagaagagaatgctggtaagaaggattcctgagtcctgtcttagcgaaggtccgctttgtcttttccatgcttgaactttcacagctgtacttggagtgttactgagtgaaagccaaaagtgcttttttaaaactaggagaccaaacaaaagtagtttacatatacactgtattcatgaagaataaaaatattatgctcttctgtttgaatttatttcttatgtactatagatcccatcatttcttttattgcaaagtgttaggaaacttcaaaataatcatctaaggtcttttaagaagatactctttgggggctgggcgtgatggctcacacctgtaatcccagcacatttgaaaaagttggtattaaatataatatccatacaaagaaagatgagactgatttagtttagaatattaataggatgaccacagttttttaatatatgagaattatattttgtaatatataacatgacaatatttaagaaagtttagctcaacttgaaaaatggttctattaagtttttgttgtagcttgggataattaaaaatactcattaaattgtactgttttcataaaaatttgtaatgcttttttatattcccactaattaagtaaaattggagcctttttttgattttaaaaattcttaaggtttaaattctagaaattgctcttttaagtgttttgctaagagtattagtaggaatttgattttagatatcttgtggagacctttccagaaaaagagggttgccttttagttcctggaccttattttaagtaagctttttggtcaaacctattctactcagctcaaaaagttgaaactattgaatttattgtgtcatcgttcttaggatccatcaattaagggaacctttcactggtctggcaatgaacagatgactaagtatgaaatggcatgtgcaattgcagatgccttcaacctccccagcagtcacttaagacctgtaagtacatggctgtaaaaacctttagatccattgctatggtatatattattgctgtgttgggtaacttcatttctcagtactaatcaaagtgaactttgcttgtatgctggctgttcatagtgctacttttctctaaattatcatctgtagagaagatcatgagtattgaagtttgtagaaaatgtattattgtcttgatcatgacaggcatttggtttatttttccagggatgatcaaatcagatttcttacactaagagcaaaaataagtagcaaatataaaacctcaaaatggccaggcacaatggctcatgcctgtaatcccaacactttgggaggctgacgcaggaggatcccttgagcccaggaatttgagactagcctgggcaatggagggagatctcatctctgtttaaaaatatatacatatttaaaaaaaggtcagggggaacaaagccctcaaaatatagcctttcacttacttttgatttttttgtgtttatctttctttaaagattactgacagccctgtcctaggagcacaacgtccgagaaatgctcagcttgactgctccaaattggagaccttgggcattggccaacgaacaccatttcgaattggaatcaaagaatcactttggcctttcctcattgacaagagatggagacaaacggtctttcattagtttatttgtgttgggttcttttttttttttaaatgaaaagtatagtatgtggcactttttaaagaacaaaggaaatagttttgtatgagtactttaattgtgactcttaggatctttcaggtaaatgatgctcttgcactagtgaaattgtctaaagaaactaaagggcagtcatgccctgtttgcagtaatttttctttttatcattttgtttgtcctggctaaacttggagtttgagtatagtaaattatgatccttaaatatttgagagtcaggatgaagcagatctgctgtagacttttcagatgaaattgttcattctcgtaacctccatattttcaggatttttgaagctgttgaccttttcatgttgattattttaaattgtgtgaaatagtataaaaatcattggtgttcattatttgctttgcctgagctcagatcaaaatgtttgaagaaaggaactttatttttgcaagttacgtacagtttttatgcttgagatatttcaacatgttatgtatattggaacttctacagcttgatgcctcctgcttttatagcagtttatggggagcacttgaaagagcgtgtgtacatgtattttttttctaggcaaacattgaatgcaaacgtgtatttttttaatataaatatataactgtccttttcatcccatgttgccgctaagtgatatttcatatgtgtggttatactcataataatgggccttgtaagtcttttcaccattcatgaataataataaatatgtactgctggcatgtaatgcttagttttcttgtatttacttctttttttaaatgtaaggaccaaacttctaaactaattgttcttttgttgctttaatttttaaaaattacattcttctgatgtaacatgtgatacatacaaaagaatatagtttaatatgtattgaaataaaacacaataaaattaacactt

SEQ ID NO: 3992 - DNA, 674 bp, Homo sapiens
tcctatgacagtacattttcctatgtaactcatgaagacatctgtaattgctttaatggtgatacacttttggccattcaggcaccttctggtacacaactggaggtacccattccagaaatgggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcagcaggatctattagtggagatatcattgatgagttaatgtcttctgacgtgtttcctctcttaaggctttctcctaccccggcagatgactacaactttaatttagatgataacgaaggagtttgtgatctgtttgatgtccagatactaaattattagattccatggaaacttgggactgttatctacctctaactgttgaccaaaatctttctaggctacagtgctgtcatcccgcatctatacaagaaacctggatcaaatacttttagtcccttctaaca

SEQ ID NO: 3993 - DNA, 812 bp, Homo sapiens
aagcttgcgccctgaggcggtttccgttcccggacgtttggactctgtcctggagaaggggaaggaaaaagtaagacgtagaagtacactgagacttcgtcacacataaaacaagcacgacaaagaaagagggcgcgaagggactcctggaagaaattgagtctacatttaagatcaccctaaaagtagtgacggcctcttcattactccaaaccccagatttaagtcggtaggacgtcttcgcgttgacttgtggggaatgtagtttcgatgctgccggcgcgttttgtttgcgacagaaactacaacccccaggggccaccgcgacgttgcctgtgggtgcccgcgaaccaacggttagcggtggcaggggctgactgagagcgtctgcttgacagagtctttctctgtcacccaggctggagtacagtggcacgatctcggctccctgcaacgtccgcctcccgagttcaagtgattctcctgcctcagccacccgagtagctgggtctacaggtgtgcgccaccatgcctggctaatttttgtatttttaagagagacggggtttcaccatgctggccaggctggtctcgaactcctgacctcgtgatccgcctgcctcagcccctcaaagtgctaggattagagataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaag

SEQ ID NO: 3994 - DNA, 3116 bp, Homo sapiens
atccccgtggcgggggcgtggccatggcgggggcgctccggcgggggcgggccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagcccggcccaccatggacccctctgcccacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcgga

SEQ ID NO: 3995 - DNA, 294 bp, Homo sapiens
atggcatcttctgcagagctggacttcaacctgcaggctcttctggagcagctcagccaggatgagttgagcaagttcaagtctctgatcagaacaatctccctgggaaaggagctacagaccgtcccccagacagaggtagacaaggctaatgggaagcaactggtagaaatcttcaccagccactcctgcagctactgggcagggatggcagccatccaggtctttgaaaagatgaatcaaacgcatctgtctgggagagctgatgaacactgtgtgatgcccccaccttaa

SEQ ID NO: 3996 - DNA, 813 bp, Homo sapiens
gcgccctgaggcggtttccgttcccggacgtttggactctgtcctggagaaggggaaggaaaaaatgggactgtctagttgcaaaaacaagctcagggatcccactgattctactttacgataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattata

SEQ ID NO: 3997 - DNA, 2856 bp, Homo sapiens
aggtcgaccgggtcaggtggttgggtgacgccccaggaaagcgctccaggccgagggcgggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaattgcaagccttttcacattcctttagtatacgttccattcagcattcaattagcatgcctgctatgagaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtg

SEQ ID NO: 3998 - DNA, 493 bp, Homo sapiens
gtagagcctttgttgggggatgaggagtgtcttgggtcgagaacaggcccctgtaacccactgagcgccccttcattccgtctctctccgccctttgtagagggtcaccatgaagttcaatcccttcgttacctcggaccgcagtaaaaaccgcaaacgtcacttcaatgccccctcacacgtgcgcaggaagatcatgtcatccccgctctccaaggagctgcggcagaagtacaatgtccgctccatgcccatccgcaaggacgacgaggtccaggtagttcgaggacactacaaaggtcagcaaattggcaaggtagtccaggtgtacagaaagaaatatgtcatctacatcgagcgggtgcagcgtgagaaggccaacggcacaactgtccacgtgggcattcacccaagcaaggtggttatcaccaggctaaaactggacaaggatcggaaaaaaattcttgaacgcaaagccaagtctcgacaagtt

SEQ ID NO: 3999 - DNA, 1134 bp, Homo sapiens
gggctcacaaaacagctacttgatgacaccattggaattcaccccacatgtggggaggtgttcacgactttggaaatcacaaagtcgtcaggactagacatcactcagaaaggctgctgaggctaggcctgctgctgtttagttctccttgtcatattctcatttctctcaaagataagaatgctctcggataaaatgagcctgtgctcatgacagctgctctgttactcagggaccagtgcagggctgtcttacgacacttagatgagaaagtagacaaggaaagaggacagcagtgggcatctgccttgtggtcttgctgacagcgagaagcagtgggactgcttccttgacgccttagcttggagccccgttatgaggtcctctcagattgcagcgggatgtttcatgaaagcctagacccggaagaataggaggataggagactgcagcagctgacctctggaagccagagctggatgagggacctgagcgagaggagacttgggcagccggagctgaaagctgagcagcagatgccactggagcctgtgagggcacgattgagtgtggggctggcttgctgctgctcccacaccactgcagaggcgtcctctctggaacatggagacaaggtttttggacaggggtttcccagtcccctggaagagattaagagactactgaagatctccagggcactgcaagccagatctgtaccctccacccaggagaaggcaaaatgtctttctggagagcctgggcagccagaggggaaaggtcaagaaacctatcctggccctgggaaagtggagggtaaggcagagccagccatgagaaaggatgatgtttgcccaggcatgaaatgtatcagcggatgatctctcacatggaagaagccaaagcagctacacccaatggcttagcaataagaaacaccaaaccagacaaacaccactgctgctgggaaagggacctggcagaaggaaaaggctgttcagagagcagaggtatttcgtgtgagccttttagggcttcttgtctctttagaccacatgcacatattacttgtataaaataatgcaccagatacaaacaatgaaatacaagtgctgagttcgatagactcataca

SEQ ID NO: 4000 - DNA, 1984 bp, Homo sapiens
cggcgcccggggcgggctcaggtgcggggttgggcggcgagagcggccgcggcgggtgtccggtgtccggtgtccggtgtccggtgtctggagccgctggctaggttcagtgaacagcattttggacaggacatttggtgccaggtctgagtagccagtttgctgaattattgtcccagtcagccaggattgtgagctgtttgggaagtttcgtggaaacgcccaagtgccagcacaggtggagggacacctggaggccagtttcaggaacttttgccacaagtataaaagacttcagaagtgcaaagatgctgaaacagatactgtcggagatgtacatagatcctgatctactggcagagctcagcgaagaacagaaacagatcctgttcttcaagatgagagaggaacagatccgacgatggaaagaaagagaagcagctatggaaagaaaggagtccctgccagtgaaacccagaccaaagaaagagaatggcaaatcggttcattggaaacttggagctgataaggaagtctgggtatgggtgatgggcgaacaccatctagataaaccctatgatgtgctctgtaatgaaattattgctgagagggcccggctgaaagcagaacaggaggcagaagagcccagaaaaactcactctgaagaattcaccaatagcttgaaaacaaaatcacagtaccatgatctgcaggctccggataaccagcagactaaagacatctggaagaaagtggcagaaaaggaggaactggagcaaggatcgaggccagcaccaaccctggaagaagagaaaatccgatcactctccagttcttcaagaaatattcaacaaatgttggcagattcaatcaatcgtatgaaggcatatgcatttcaccagaagaaagaatctatgaagaaaaaacaagatgaagaaataaatcaaatagaagaagagagaacgaagcagatttgtaagagctggaaagaagactcggaatggcaggcatctctgcgaaaatccaaagcagctgatgagaagagacgctccttggctaaacaagcacgagaagactacaagaggttatccctcggggcccagaaaggaagaggcggtgagaggctgcaaagccccttgcgtgttccgcagaaaccagaaagacctccccttccacccaagcctcagttcctaaactcaggggcatatcctcaaaaacctcttagaaatcagggagtggtgaggacactgtccagctctgcccaagaggacatcatccggtggtttaaagaggagcagctaccacttcgagcgggctaccagaaaacctcagacaccatagccccctggttccatggaattctcacactcaagaaagcaaatgaacttcttctgagcacaggcatgcccggcagttttctcatccgagtcagtgaaaggatcaaaggctatgccctgtcctatctgtcggaggacggctgtaaacatttcctcatcgatgcctctgcagacgcctacagcttcctgggcgtggaccagctacagcatgccaccttggcggatttggtggaatatcacaaggaggaacccatcacttccctggggaaggagctccttctctatccctgtggtcagcaggaccagctgcctgactacctggagctgtttgagtgacagcctccatcagggtcatcctacagcctccaagcgggctttcccctggacaaatgccactgcaacatttatgtgtgaagccaaaatcaccctgcagcagagccaatactgatcaactgaaagtaaagtatccatggagtcctcattgacacctcttttctgcacaaatactggaattcaatgtcaagagaaaatgacctctgctcaaaagggagaagagtctcaatttcagcaagtacctgtcatgaagggtatgaccttaatgatgtacataaaataaaacaaatgaagaaatggaaaacttttagaaa

SEQ ID NO: 4001 - DNA, 679 bp, Homo sapiens
agtagccgggtgagtggaggctggagttttctcggacagtgaactctaccgccccagggtcaccatgaagttcaatcccttcgttacctcggaccgcagtaaaaaccgcaaacgtcacttcaatgccccctcacacgtgcgcaggaagatcatgtcatccccgctctccaaggagctgcggcagaagtacaatgtccgctccatgcccatccgcaaggacgacgaggtccaggtagttcgaggacactacaaaggtcagcaaattggcaaggtagtccaggtgtacagaaagaaatatgtcatctacatcgagcgggtgcagcgtgagaaggccaacggcacaactgtccacgtgggcattcacccaagcaaggtggttatcaccaggctaaaactggacaaggatcggaaaaaaattcttgaacgcaaagccaagtctcgacaagttggaaaagagaaaggcaaatataaagaagaacttattgagaaaatgcaggaataaatagaacctgttgtgcaaccacggtttaaccggagattttgaggctagggtgtgtttctttcgaacttttcggaatgtctggaacatttcatttcctgttttgttacctgtgcctctgtaaatctacttttgcaattttaagtaataattttatgaataaaaatgggaaatgcttcc

SEQ ID NO: 4002 - DNA, 965 bp, Homo sapiens
aagcgcccccggaggcgctaagcttgcgccctgaggcggtttccgttcccggacgtttggactctgtcctggagaaggggaaggaaaaaacagagtctttctctgtcacccaggctggagtacagtggcacgatctcggctccctgcaacgtccgcctcccgagttcaagtgattctcctgcctcagccacccgagtagctgggtctacaggtgtgcgccaccatgcctggctaatttttgtatttttaagagagacggggtttcaccatgctggccaggctggtctcgaactcctgacctcgtgatccgcctgcctcagcccctcaaagtgctaggattagagataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaa

SEQ ID NO: 4003 - DNA, 2107 bp, Homo sapiens
cgctggcgttccgcgcacgccggctcactgcgcctgcccggcgtgtggacgccacacgctcccggaagtgggaggtggccgctggagtttgtgtggccgccgccgcgggaacgcgagcccggtaatttttcaacggagaaaggcgaggctttcgggctctgcagagtgagagttagcaagtgtccggctccagcaactctcctctggcgtgacagccggcatggaggatccacagagtaaagagcctgccggcgaggccgtggctctcgcgctgctggagtcgccgcggccggagggcggggaggagccgccgcgtcccagtcccgaggaaactcaacagtgtaaatttgatggccaggagacaaaaggatccaagttcattacctccagtgcgagtgacttcagtgacccggtttacaaagagattgccattacgaatggctgtattaatagaatgagtaaggaagaactcagagctaagctttcagaattcaagcttgaaactagaggagtaaaggatgttctaaagaagagactgaaaaactattataagaagcagaagctgatgctgaaagagagcaattttgctgacagttattatgactacatttgtattattgactttgaagccacttgtgaagaaggaaacccacctgagtttgtacatgaaataattgaatttccggttgttttactgaatacgcatactttagaaatagaagacacgtttcagcagtatgtaagaccagagattaacacacagctgtctgatttctgcatcagtctaactggaattactcaggatcaggtagacagagctgataccttccctcaggtactaaaaaaagtaattgactggatgaaattgaaggaattaggaacaaagtataaatactcacttttaacagatggttcttgggatatgagtaagttcttgaacattcagtgtcaactcagcaggctcaaataccctccttttgcgaaaaagtggatcaatattcggaagtcatatggaaatttttacaaggttcctagaagccaaaccaaactgacaataatgcttgaaaaattaggaatggattatgatgggcggcctcactgtggtcttgatgactctaagaatatcgcccgaatagcagttcgaatgcttcaggatgggtgtgaactccgaatcaacgagaaaatgcatgcaggacagctaatgagtgtgtcctcttccttaccaatagagggcactccaccaccacaaatgccacattttagaaagtaacaacagttttgtgtgtggatcattccaattgaagttgctatgaagagggagaagtttctgcctggattgaaacaaaaaaacacaggcgtcacaagcatgttacctattaagagagagagggtatctctgaagactaattaaaatggtaatttttaaaaagatgtgaccagttgacttttagtatatcatcccaagtattatccccaaaatgataatgcaaaacagaataatttggagaccaggagaaaaactggtatgattactggggaggggaagaagcacaggtggtcaagataataatgcatgtttggcctcagctgtagttgccaaagaaactacctgcctcacagatgagcacgcacgggtgcattgtcaaagtctgagaaggatgtattgtactttgaaggaagactttccatttctaagctaccatggagaagtatatgctcctcgagaccagagactgtgacttctgcatctttgattccagcgacatatgataaaatgttttgcacatagttgaatccagcgttgatacatgaaggacagcattacatcttttttctattatacttagaaatttcctctttgttctgcaccaccaacctgtatatcaagcctccttgccccacaaagcttccaaagcccgtaaatttgttaatctagagcaggggtcagcaaactaccacccatgggccaaatctggctgctgcctatttttgtatggcctacaaactatggtttttatattcccttttgttaatggctcaaaataatattttgtataatacgaaaattacgaaattttagtttctctaaataaagttttggaaagaa

SEQ ID NO: 4004 - DNA, 692 bp, Homo sapiens
gctgtagtggcttcgtcttcggtttttctcttccttcgctaacgcctcccggctctcgtcagcctcccgccggccgtctccttaacaccgaacaccgtgagtagccgcccactgaactggaaagggtcgtggctaccggattgcgtgccggctggcctcaccgctgcggtttgggcctgcccgcggcgggcggtgactgggcctggccttctttcgggcccggtggatcgcgttgtcgaccctgttcttcgggagaccctaccagatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaa

SEQ ID NO: 4005 - DNA, 577 bp, Homo sapiens
attacgagattggcttggattctgtcggatggacttggggctagctgcggcggggctggatggtgctgtattgaatttttggacggtactgcattggaggattttaagcttgggcagtaggacattgtattaatctgttttcacattgccaatgaagacatagcccagacctgccaatttactaaagaaaggaggccagataaccatgtcagccacagttgtagatgcagttaatgctgcacccctatcggggtccaaagaaatgagtttggaagaaccaaagaagatgaccagagaggactggagaaagaagaaggagctagaagaacagcgaaaattgggcaatgctcctgcagaagttgatgaagaaggaaaagacatcaacccccatattcctcagtatatttcttcagtgccatggtatattgatccttcaaaaagacctactttaaaacaccagagaccacaaccagaaaaacaaaagcagttcagctcatctggagaatggtacaagaggggtgtaaaagagaattccataattactaagtaccgcaaaggagcatgtgaaaattgtggg

SEQ ID NO: 4006 - DNA, 1144 bp, Homo sapiens
ggaggggagacgcgaaactttccgggcgcttcctcccgcggtcccggagccgtcgcagcgccgggaggtgtcgtcgtcgcgggcggtggcggccgacgccatgttggggtctgtgagaaacggggcgctcccggccgctcccctcgcgccggggccggcccgcgggccagttgccgccgccgtcccgccagcccgggagcgagccgcgcccgcccgtaggacgccgccgccgccgcggggggacgggggccgccgggctattagtgaaagatggtggatcgcttggcaaacagtgaagcaaatactagacgtataagtatagtggaaaactgttttggagcagctggtcaacctttaactatacctggacgagttcttattggagaaggagtattgactaagttgtgcaggaaaaagcccaaagcaaggcagtttttcttgtttaatgatattcttgtatatggcaatattgtcatccagaagaaaaaatataacaaacaacatattattcccctggaaaatgtcactattgattccatcaaagatgagggagacttaaggaatggatggctaatcaagacaccaactaaatcttttgcagtttatgctgccactgctacggagaaatcagaatggatgaatcatataaataaatgtgttactgatttactctccaaaagtgggaagacacccagtaatgaacatgctgctgtctgggttcctgactctgaggcaactgtatgtatgcgttgtcagaaagcaaaattcacacctgttaatcgtcgccaccattgccgcaaatgtggttttgttgtctgtgggccctgctctgaaaagagatttcttcttcccagccagtcctctaagcctgtgcggatttgtgacttctgctatgacctgctttctgctggggacatggccacatgccagcctgctagatcagactcttacagccagtcattgaagtctcctttaaatgatatgtctgatgatgatgacgatgatgatagcagtgactaaggacacatttgggagtatttaatcaggtgtggctatctgagaaatcaactttgggggaaatgtaagattctgagctctctctctgttttgttctagccatgaatttgcctgagaaacttgtaac

SEQ ID NO: 4007 - DNA, 233 bp, Homo sapiens
accctgccctatgtgtcgcgggaacacatgtcaccccacagctctctttgagtgacctcccgaccacccattcctgcctaaccctagcattccttcctcagcctcaagagggtcaccatgaagttcaatcccttcgttacctcggaccgcagtaaaaaccgcaaacgtcacttcaatgccccctcacacgtgcgcaggaagatcatgtcatccccgctctccaaggagctgcg

SEQ ID NO: 4008 - DNA, 1734 bp, Homo sapiens
aattccgacggggacgcgctgaggagcaggggtgaagggtgaaaagcgtcattcgaggtccgggtccggcttgcggggtcagcgaactggagaggcgccatgggctggatcacagaagatcttattagacggaatgctgaacacaacgactgtgtcattttttccctggaggaactctcgttgcatcagcaagaaatagaaagactagaacacattgataaatggtgccgggatttaaaaattctctatcttcaaaataatcttattgggaaaattgaaaatgttagcaaactcaagaaacttgaatatttgaatttagctttaaacaacattgaaaaaatagaaaacttggaaggatgtgaagagctggcaaaacttgacctgactgtgaatttcattggagagctgagcagcattaaaaacttgcagcacaatatccatctgaaggagctctttctcatggggaacccatgtgcttcctttgaccactatagggagttcgtggtagcaactcttccacaattaaagtggttggatggtaaagaaatagagccttcagaaaggattaaggcattgcaggactattcagtaattgaaccacaaatcagagagcaggaaaaagatcactgtcttaaacgagccaaactcaaggaagaggctcagaggaaacaccaagaagaggataaaaatgaagacaagagaagtaacgcaggctttgatggacgttggtacacagacatcaatgctactctttcctctttagagagcaaagaccacctacaggcaccagacacagaggaacacaacacaaagaaattagacaacagtgaagatgacttggaattctggaataagccctgtttgtttactcctgaatcaagattggaaactcttagacacatggaaaaacaacggaagaaacaggaaaaattaagtgaaaaaaagaagaaagtgaaaccacccaggactttgatcactgaagatgggaaagccctaaatgtgaatgagcccaaaattgacttctctttgaaagataacgaaaagcagatcatcctggaccttgctgtctataggtatatggatacctctttaatcgatgttgatgtgcaaccaacttacgtgcgagtaatgatcaaaggaaagccatttcagcttgtccttcctgcagaagtgaaacccgatagtagttctgctaaaagatctcagacaacgggtcatttggtcatctgcatgcccaaggtaggagaagtaatcacaggtggtcagcgagcattcaaatctatgaaaactacctcggacaggagcagagaacaaacaaatacaagaagcaagcacatggagaaactagaagtagaccctagcaagcactcattccctgatgtgactaacatagttcaagagaaaaaacacacacccagaagacgacctgaacccaaaattataccaagtgaggaagacccaacctttgaagacaaccctgaagtgcctccgctgatttgaaacatctggctgcgttgccattggctgagacccaccaggtccagttttggttggtgtagagaccatatgcatattattcctgggataaacacagagttatttgtcaatatcgctgctccagtgttttaactcttactttgcatagtaatatccttaagatagcttaaaattaaaatgtatgtcttaaatgctataactcatcatttacctataataaagggttggtattgaaaa

SEQ ID NO: 4009 - DNA, 652 bp, Homo sapiens
tcgtcatggccagtgtctgtctggcgcccggtgcccaggcactgtgcgagaccagtccgcaggggcgactcggagagcgccgggccgcggcgggagaagagcctgcagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagaagtaaaataagtgaacttacaactgaagttaataaacttcagaagggaatagaaatgtacaatcaagagaattcagtatatttgtcatatgaaaagagggctgagactttagctgttgagataaaagagcttcaaggacaactagcagactacaacatgttggtagataaacttaataccaacactgaaatggaagaagtaatgaatgattacaatatg

SEQ ID NO: 4010 - DNA, 695 bp, Homo sapiens
ggcgaacgaaacgcggagctcgggagcgacccggcggggccaggcacgggcagaagggccaagagggccacagagggtcaccatgaagttcaatcccttcgttacctcggaccgcagtaaaaaccgcaaacgtcacttcaatgccccctcacacgtgcgcaggaagatcatgtcatccccgctctccaaggagctgcggcagaagtacaatgtccgctccatgcccatccgcaaggacgacgaggtccaggtagttcgaggacactacaaaggtcagcaaattggcaaggtagtccaggtgtacagaaagaaatatgtcatctacatcgagcgggtgcagcgtgagaaggccaacggcacaactgtccacgtgggcattcacccaagcaaggtggttatcaccaggctaaaactggacaaggatcggaaaaaaattcttgaacgcaaagccaagtctcgacaagttggaaaagagaaaggcaaatataaagaagaacttattgagaaaatgcaggaataaatagaacctgttgtgcaaccacggtttaaccggagattttgaggctagggtgtgtttctttcgaacttttcggaatgtctggaacatttcatttcctgttttgttacctgtgcctctgtaaatctacttttgcaattttaagtaataattttatgaataaaaatgggaaatgctt

SEQ ID NO: 4011 - DNA, 4532 bp, Homo sapiens
ggaacctcggctcccgggaagccccgagcctgggggaaccctgggcaccctgtgaaccctgtggtctgcactggctgccctgctgctgtcgcggggctgcgggcggacgacctgagcccgagctccgagggcccggagcggggcgccagggcctagggtcgcgggggccaggggcgcgccagggtggctgagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactggaatctcccaacagagaaattattattttacacaatccaaagcttatggtgcattaccagccagttgcagggtctgatgattggggttcaacacccacggagcagggtcgaccaagaactgtgaagagaggagttgagaacatctctgttgacattcattgtggagaacctttacaaatagatcacttggtttttgtagtccatgggattggaccagcttgtgatctccgctttcgaagcattgtacagtgtgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaaggattcgctaaatattgtaatggatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaagatattaaactatttcagcaccagaaaaaactcaatgggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaacatgaaaccata

SEQ ID NO: 4012 - DNA, 703 bp, Homo sapiens
gcgaggagtcgctcgggcacttattgagcgccgactgtctacgggcggccggggacagtcttgcactgtttcctaggctggagtgcagtggcacaatcacagctcactgcagccttgacttccccaggctcaagccattctcctacctcagcctcccaagcagttgggaccacaggtgatgggcagaggcttcagtgtccccttcgcctccgcaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaa

SEQ ID NO: 4013 - DNA, 610 bp, Homo sapiens
tgtaagattatatctttttcctaacgactcataattaatctgaattaataaatgcgttttcagagcaagtaataggttattattatggagatcttgccaagagatctcaaagttggtcacctggacagtcagtactgaaagataaaaagggctctgaaatgaagcttttaagtagatttagggaattgtactcacatctgcttatctttaaatcattttattctcttgtatatggtcttgcattgcctcagacataaatgagcatattctgatgtactctttggatctgaactcatcttcacagatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaa

SEQ ID NO: 4014 - DNA, 3832 bp, Homo sapiens
ggggtcgagtcagtgccgtttgcgccagttggaatcgaagcctcttaaaatggcagatgatttggacttcgagacaggagatgcaggggcctcagccaccttcccaatgcagtgctcagcattacgtaagaatggctttgtggtgctcaaaggctggccatgtaagatcgtggagatgtctgcttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtaccagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccaaggtggcagtggtggcagcagtgatcctccgaacctgcagaggccccctcccccagcctggcctggctctggcctggtcctaggttggactcctcctacacaatttatttgacgttttattttggttttccccaccccctcaatctgtcagggagcccctgcccttcacctagctcccttggccaggagcgagcgaagccatggccttggtgaagctgccctcctcttctcccctcacactacagccctggtgggggagaagggggtgggtgctgcttgtggtttagtcttttttttttttttaaattcaatctggaatcagaaagcggtggattctggcaaatggtccttgtgccctccccactcatccttggtctggtcccctgttgcccatagccctttaccctgagcaccacccaacagactggggaccagccccctcgcctgcctgtgtctctccccaaacccctttagatggggagggaagaagaggagaggggaggggacctgccccctcctcaggcatctgggaagggcctgcccccatgggctttacccttccctgcgggctctctccccgacacatttgttaaaatcaaacctgaataaaactacaagtttaatatgaaaaaaaaaaaaaaagaaagaaagacgtgtaaaatgccaagaactctaggaaacagggacaaaaacacttcaaagagaaagttcatgcacttgtttctgaccacccagggcacccttcagcacacgctgtctggagtggcctgaagcaaggagtgtcttgtgaggtgcagaggatgcaatgggagcagggtcctgtccccaccctaaaggagttcacagtttaacgcaaatgagaagccagtgaggacatcactactcctgctgtgaacttgggaactagaaacacaaaacctgagtctggagggaagctaaggaagcattctgctctggagtagacatgagtgcgtgtgaagcttctgatctcccatgagagcaatggggacatggggcagaatctaaaacccatgactgaaagcaccaaattgctaaaatggcaataaagagacatgaggccaagatggagaagaaggaacccaggacgagggtcagcctcacatttggggctcatttccctcagtttcctcactgaatttcagaagggactaactgagatgcaaagaagcagagcagcttttgcaccatgtggaggactagatggaaaacaagtagactgagggtctgctagtgaaggtgacccctactgaagtccactggctttggttgggacccagaagagtcacacgccaggaatagaggtggacaggaaacaccctgacttttgtagggactgaacctcactgataacctcaattgcggatggtatggagggtgtctaggtgtgctaggacccctgcccattccccagaaatagactcccatcttttctacagcaagataacgtgctagtaggcctcaattcattgctaaatatttttaacgagtgtcttacatttagccaaaaagactagtcatgtggcaggaaaaatacaatgtcatatgaccaaaagctaaaagactgtgaaaatgaatccagaggtgacccaagcattgaatttaacaatgccagtacctggacctccgcttgcccctaaaacattacaatcaagaatgtaggaagggaaaggaaacacgaagattaatcaagcaggaaggacaagctcagttttgcacccactgaatttgccacaaatattgtggaaaatattctcggggacattgcagttgtctactttggttggcacatggttcatacaacagtgtttgtgtcagtgaacatcttactcttcctcggcagtctttctttgcccagagatttcgcaatgactgttgaccttcatcatcaccttttggactttggcttgcactttagcttctgtagatctccatgatgtaaagaagtattttaggtccattttaattcctgcaaaggataaaatccttctatttgtgtgcatataagtggacctgagcccttggttagggtgtagagaggagaaggggagaaacctgagggccagaagctgttctttcccttaaaagggcaaactcatttccacactatggggactctgacagatagcataccttcctgtctatggctattggacctgcaggctttcccctgtaaatccgtgttctgtcattgacattttgtgactgtaagacagacttgagataagacatctagaaaacaataattgaacaatgatgtgaatatatttcacacaactgaactgtacatttcaacaaggttaagatggtaattatcacgttatacattttttaccgcaggttaaaatgtttcacaggttgaaaggaaagcaactaccttcagttctctgagttcaagaatttgtaacatttcaccccctgctccttcctgatcttctgtggagcatcttttttccatccatgctctactcagagcccactttcccttccctgacaccagcttcactgaggctggttggaacctaacacaaaacattctcagtaatgactgaattcccacaaagaattccatatagactgcatatgagttgaatcttctaagacatgaaatatttgttctcttcttggctaatatgcaatgcaaatcctgttgcagatgtacgtcatatacctctgaaattcctgatgtattcaatgaaataacatctttaaagttctgtgtagaatgttttttttctgatttcttcacatacgatagaaaaaaaaacccaaaaaaacatgtactaggatttcaatagaagcaatgggtgatctaaaaagatgaaagagcaaccgcatgcgccctacagctaccgctagattttatggggaaagcagctggcccagtttgcagctaggagaaatgtcaaacacatgaagaaatgagaagcaaagaaaaaccatgaggcatgaacatttcatggcaatcacgatgtcctggtttgtgagataatgggatagaggagtagaaaacaaggagaaagatgagaaggtacaaagtggttcaagtcaaacagctcaactgaacttttcttaatggaatatttaaaaagtggtacattaaaaaacttcccccagttcacatcaaaaattctctcttcaggactaagttgggtagagactgttcaatgtgcctagatatcttcagaacttatatattttctgttttctacgtatgttgaagggcagtgccaaatgatgtgtaattatctaggttgtaaaaataaaacatactcccccttcccttgagg

SEQ ID NO: 4015 - DNA, 807 bp, Homo sapiens
attacgagattggcttggattctgtcggatggacttggggctagctgcggcggggctgggtaagaaaatattgttagaacttgcgggcgacggggagttggggaacctgagaaaatgagtcgaaggctcctaattattggatatatcttcacgggggtgatgagccctcaggtgttgagggagcgaggacgggggaccgaaaagccactgtcctgagacccattcatggcactcgtgccctgccaggccaggcctgcgtcttcagggaaacagtcgggataactatgagagtgtcgcctttgtggcggtgcctcgaagaccttgagcaatccccggactgcgagcagggaaagctgcttccagtacccaaattgacagactgtatttcctcgccagaaaaatttacttgagcttcagtttttcctgttaagtcgagatgatccgacttcagtggggtatcatgcgggtataaatgaaaacatctataggaggccagataaccatgtcagccacagttgtagatgcagttaatgctgcacccctatcggggtccaaagaaatgagtttggaagaaccaaagaagatgaccagagaggactggagaaagaagaaggagctagaagaacagcgaaaattgggcaatgctcctgcagaagttgatgaagaaggaaaagacatcaacccccatattcctcagtatatttcttcagtgccatggtatattgatccttcaaaaagacctactttaaaacaccagagaccacaaccagaaaaacaaaagcagttcagctcatctggagaatggta

SEQ ID NO: 4016 - DNA, 3321 bp, Homo sapiens
acttccggtgcttgccctgcccatccccgtggcgggggcgtggccatggcgggggcgctccggcgggggcgggccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagcccggcccaccatggacccctctgcccacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcgga

SEQ ID NO: 4017 - DNA, 806 bp, Homo sapiens
agtcccggttccccgccatcagcacgacctgtgtgagagcacagggtatctgggcagaaggaaaactaggggagcctcatccagcgctggagatggagaagctttgggcttctcgacggcgaggcacccggggaacggggagtcacttagaacctcaaagtagcctcgggcgagaacaagcgaagcaattccaagctctaccaggtcacggagggcgcgaaacccgccccgcgctccggccggccggcagggggcgcgcgctccccgaactcccgcgcaccgcggaggaggcggccctggcgcggggaagcagtgggaaaatcgcaaggaagccggcgctgctctgaagggagagtctgtgcagtggcacctgcgcgaagctggccaaagcctgcccagacggctcacctgtgcgggatggaacaaaagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggctta

SEQ ID NO: 4018 - DNA, 584 bp, Homo sapiens
acttattgagcgccgactgtctacgggcggccgggggcctgagccgcgccttgctgctgggtctccacttgtggggaagagagaactggaccaggacagcgcgggaaactgacaatgccactgcttgctagctttgggattttggacaaataggtgatgggcagaggcttcagtgtccccttcgcctccgcaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctgg

SEQ ID NO: 4019 - DNA, 742 bp, Homo sapiens
cacgccgccggccgccgtttagtcccagagatagaaaaaagtagaggtaggagggcgcggcggctcacgcctgtaatcccagcactttggaaggccgaggcgggcggatcacgagagggtcaccatgaagttcaatcccttcgttacctcggaccgcagtaaaaaccgcaaacgtcacttcaatgccccctcacacgtgcgcaggaagatcatgtcatccccgctctccaaggagctgcggcagaagtacaatgtccgctccatgcccatccgcaaggacgacgaggtccaggtagttcgaggacactacaaaggtcagcaaattggcaaggtagtccaggtgtacagaaagaaatatgtcatctacatcgagcgggtgcagcgtgagaaggccaacggcacaactgtccacgtgggcattcacccaagcaaggtggttatcaccaggctaaaactggacaaggatcggaaaaaaattcttgaacgcaaagccaagtctcgacaagttggaaaagagaaaggcaaatataaagaagaacttattgagaaaatgcaggaataaatagaacctgttgtgcaaccacggtttaaccggagattttgaggctagggtgtgtttctttcgaacttttcggaatgtctggaacatttcatttcctgttttgttacctgtgcctctgtaaatctacttttgcaattttaagtaataattttatgaataaaaatgggaaatgcttcctaa

SEQ ID NO: 4020 - DNA, 446 bp, Homo sapiens
gttgcctgtgggtgcccgcgaaccaacggttagcggtggcaggggctgactgagagcgtctgcttggttgggaaaccaattagaaaggagtgttctgctagaaacagataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaa

SEQ ID NO: 4021 - DNA, 578 bp, Homo sapiens
ttattgcgaggatggagggaggcgcaggcgttctcattcatagttctcccatcctgaaagttctgttcctcttttgtccagaaactgggccctcgtcagactgccttgccctgttcctgactcaggccaaggcctgcagccgggaagaggttggggcggcgtgagttatgtgaaaagcgctcagaatacagtatgtcatgtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaa

SEQ ID NO: 4022 - DNA, 770 bp, Homo sapiens
gcttccgcgttccctgcacaaaatgccgggcgaagccacagaaaccgtccctgctacagagcaggagttgccgcagtcccaggctgagacagggtctggaacagcatctgatagtggtgaatcagtaccagggattgaagaacaggattccacccagaccaccacacaaaaagcctggctggtggcagcagctgaaattgatgaagaaccagtcggtaaagcaaaacagagtcggagtgaaaagagggcacggaaggctatgtccaaactgggtcttctacaggttacaggagttactagagtcactatctggaaatctaagaatatcctctttgtcatcacaaaactggacgtctacaagagccctgcttcggatgcctacatagtttttggggaagccaagatccaagatttatctcagcaagcacaactagcagctgcggagaaattcagagttcaaggtgaagctgtcggaaacattcaagaaaacacacagactccaactgtacaagaggagagtgaagaggaagaggtcgatgaaacaggtgtagaagttaaagacgtgaaattggtcatgtcacaagcaaatgtgtcgagagcaaaggcagtccgagctctgaagaacaacagtaatgatattgtaaatgcgattatggaattaacagtgtaaccatctgaaagcaactttttttggtgtctcaaaggagtaactgcagcttggtttgaaatttgtactgtttctatcataaataaagttatgacttcttgct

SEQ ID NO: 4023 - DNA, 568 bp, Homo sapiens
tttcttgcaaactttgtggcacgttttctgggaagaaaaaactaggatcgtgtaatattaaaaaataaatcgagaggctttttttttttgctctccatattattaagctgcatggactgagaggaggccagataaccatgtcagccacagttgtagatgcagttaatgctgcacccctatcggggtccaaagaaatgagtttggaagaaccaaagaagatgaccagagaggactggagaaagaagaaggagctagaagaacagcgaaaattgggcaatgctcctgcagaagttgatgaagaaggaaaagacatcaacccccatattcctcagtatatttcttcagtgccatggtatattgatccttcaaaaagacctactttaaaacaccagagaccacaaccagaaaaacaaaagcagttcagctcatctggagaatggtacaagaggggtgtaaaagagaattccataattactaagtaccgcaaaggagcatgtgaaaattgtggggccatgacacacaaaaagaaagactgctttgagagacctaggcgagttggagccaaatt

SEQ ID NO: 4024 - DNA, 699 bp, Homo sapiens
gtcttgcactgtttcctaggctggagtgcagtggcacaatcacagctcactgcagccttgacttccccaggctcaagccattctcctacctcagcctcccaagcagttgggaccacaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgg

SEQ ID NO: 4025 - DNA, 492 bp, Homo sapiens
ctttcattttcagccctgctctttaaatactagacataccgtctggcgcatgtcgaggcgtgtattattttgatccagtgcgcgtgccgtatgtgacttggcttggcttcccctgaaagcagcggctgtggggagttgattcggaagtgaagggccctgggcgacccggcgagtagaggcaacaccaacactcctccttagcgaggggtctccccgccgcggtggctgcccggccccaaggacaggagggatttgtgcactgactcctgaccccgtcctccagcgctgctctgaagggagagtctgtgcagtggcacctgcgcgaagctggccaaagcctgcccagacggctcacctgtgcgggatggaacaaaagtttgtttcgacgccggaccgcgtaagagacgatgatgttgggcacggaaggtggagagggattcgtggtgaaggtccggggcttgccctggtcttgctcggccgatgaagtgcaga

SEQ ID NO: 4026 - DNA, 575 bp, Homo sapiens
cttgcgccctgaggcggtttccgttcccggacgtttggactctgtcctggagaaggggaaggaaaaagtaagacgtagaagtacactgagacttcgtcacacataaaacaagcacgacaaagaaagagggcgcgaagggactcctggaagaaattgagtctacatttaagatcaccctaaaagtagtgacggcctcttcattactccaaaccccagatttaagtcggtaggacgtcttcgcgttgacttgtggggaatgtagtttcgatgctgccggcgcgttttgtttgcgacagaaactacaacccccaggggccaccgcgacgttgcctgtgggtgcccgcgaaccaacggttagcggtggcaggggctgactgagagcgtctgcttgtgcctggtacctagtacaaacttaataaatgtgtgacgcaagaataaaggaatgaatgaatggaagaatgatataatgccacagaactttcaaagataatggattctgaattaatgcatagtatagtaggaagctatcataaacctccagaaagagtatttgttccctcattcacccagaatga

SEQ ID NO: 4027 - DNA, 1287 bp, Homo sapiens
actcggcggtggcgtccgtgttgttattgtggtggtagcggcgtctggctgctgcggaccccgccgagtcctagcgcctggcctgcgcgccgctgcccgcgccacaggattaatttatttttggaaatcaagtgcaatattggaagccatttctactaattttatttcacttttaaatttatgatttgatttgaatactatcatgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatggtgggcttaattttaggtccttttggaataaatcatgggattgagcttcattcagatgtggtggaatatgccaaggaaaaactggagagcttcatcaaaaatagtgatagctttgataaatttgagttctgtgaacctgcatttgttgttggtaattgcctccagatagcttctgacagtcatcagtatgatcgaatttattgtggagctggagtgcagaaagaccatgaaaactacatgaaaatattactaaaagttggaggcatattagtcatgcctatagaggatcagttaacacagattatgcgaactggacagaacacttgggaaagtaaaaatatccttgctgtttcatttgctccacttgtgcaaccaagtaagaatgataatggcaaaccagattctgtgggactccctccctgtgctgtcaggaatctacaggacttggctcgtatttacattcgacgcacacttagaaatttcataaatgatgagatgcaggccaaggggattcctcaaagggctccacccaaaaggaaaagaaagagagttaaacagagaattaacacttacgtatttgtgggtaatcagcttattcctcagcctctagacagtgaagaggatgaaaaaatggaagaggataacaaagaagaggaggaaaaagatcacaatgaagcaatgaagccagaggagccacctcaaaatttactgagagaaaaaatcatgaagctgcccctccctgaatctttaaaagcttacttgacatattttagagacaaataacttagatcaag

SEQ ID NO: 4028 - DNA, 1683 bp, Homo sapiens
cgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtaggtagcacacagttttgtctttgatcacatgctcttaaaaagggagtaacacctataacatgccagcaaaagaggtgactgtatcaagtagtcttgatactttagggataatatgtacttaatgtgtcttaaacatactcttactgttctgtctttatgaatctgaacacttagatgatactgcattttaagcataagaacaattagttttcaatgagaagagctcttgttaatgtattaacagttactagttttggcacctgcaactttctgtatagaccatacatatctgacatcagaaaagcaggccctagagagaagtatatactagggtactttagagcaacttaatgaggggaggaaatgaaagaatagatcagaatgattttgttgacatgactacagactgaaataatgtgaatgaattaactgaatttgctctgtcaactttagtaaattgcccattgcctttgctttgttcataatttcagcagggcagaataaaaaccatgggaggcaaagaaaggaaatccggaaatatagtcttaacctggtgttgttctaattttccatctgttcttctgactcaactcactggctatcgatgaatcagtaggtagtatttataagtcttaggaaagactactcaagttaaggtacttccctatatccatctcttttaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaagttttctggaatagaattaacaaaa

SEQ ID NO: 4029 - DNA, 769 bp, Homo sapiens
gcgacgttgcctgtgggtgcccgcgaaccaacggttagcggtggcaggggctgactgagagcgtctgcttgattcaggttatgctttctggccagaatactgcataggtgatgttgcgtccttctccaggtttcatatccagaggcacatggtggccttctacctctcacagacagagtctttctctgtcacccaggctggagtacagtggcacgatctcggctccctgcaacgtccgcctcccgagttcaagtgattctcctgcctcagccacccgagtagctgggtctacaggtgtgcgccaccatgcctggctaatttttgtatttttaagagagacggggtttcaccatgctggccaggctggtctcgaactcctgacctcgtgatccgcctgcctcagcccctcaaagtgctaggattagagataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaa

SEQ ID NO: 4030 - DNA, 501 bp, Homo sapiens
ggagccgggccgcgggccgcgccgggagggcgggcagggccgcggccgctgcagcccggagctgagctagccgtccgagccgagccgtccgagccggggaagccgggcgcgtgctgccgctcgtggcgggccgaggtgatgggcagaggcttcagtgtccccttcgcctccgcaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtca

SEQ ID NO: 4031 - DNA, 802 bp, Homo sapiens
gctgtagtggcttcgtcttcggtttttctcttccttcgctaacgcctcccggctctcgtcagcctcccgccggccgtctccttaacaccgaacaccacataaatgagcatattctgatgtactctttggatctgaactcatcttcacagatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcaca

SEQ ID NO: 4032 - DNA, 729 bp, Homo sapiens
ggacatgtgactctcccacctcgtttcgtggcagagccaaagagctgagcaaaaggagctgctgcagcttgaagaaaaagccacccctgaaggctcctgccagagccaggcttaccttctctccctcgagaatcttctcccgaaggaccagcccagggaagggaagcagctgctctggactcactcaagtgtgtctcacaccccttcctcttccagcagcagctacctggcaactgaacccatcatcaccacagccactcctgcagctgccacggtttctgccacctctaagatgtgccctggtaactggctttgggcttctatgacttttatggcccgcttctcccggagtagctcaaggtctcctgttcgaactcgagggaccctggaggagatgccaaccgttcaacatcctttcctcaatgtcttcgagttggagcggctcctctacacaggcaagacagcctgtaaccatgccgacgaggtctggccaggcctctatctcggagaccaggacatggctaacaaccgccgggagcttcgccgcctgggcatcacgcacgtcctcaatgcctcacacagccggtggcgaggcacgcccgaggcctatgaggggctgggcatccgctacctgggtgttgaggcccacgactcgccagcctttgacatgagcatccacttccagacggctgccgacttcatccaccgggcgctgagccagccaggagg

SEQ ID NO: 4033 - DNA, 1790 bp, Homo sapiens
gctagccgtccgagccgagccgtccgagccggggaagccgggcgcgtgctgccgctcgtggcgggccgaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctccca

SEQ ID NO: 4034 - DNA, 3616 bp, Homo sapiens
gacgcgcgacggttcgtgcgtgcgtgcgggcggctgcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcagagactgtgccatttctattatgttgatgtatatgtacagtaccttgccagggaagcaaaaattggaattattgtagcttttcatgtatacacacttttatttaccctattttgtgtacttcttgtgaattataatttgcagactatttcagaaaagaaattatctagtttaatttcttctttggacaaggagtcctaggtattatattttgagtttgatttcaccagaaataataatattaaaaagatctttgcattctggcagttcttttaggattataggttgcaaattatccaaatatatatcccattttttaaagcataatatcttttttagttgtttttctgtgaagcttttggttaataaatagggtcaactaattggagacttttctcttccaattagggcttttaatactaacaaggataactttattcattcctcgtattctctactctaacaaatatgaactctgaagttgaaaagtcatttatgttccgctttcaccaaagtgacgtgaggctttaggtcactgtttcacttcaaagtactggatccaaagctttgttgaaaatgctgtttgatgaattcactgaagaatatagaaaggtggtcaggtaaagtctacttttattttgtcaagcttaataatttgtgtcatactttaccccagtatatataggcaaaccaaaaccttatcaaatattaaattagttgtttaaactttgcttataaagtattggccatgtggtggctcatgccgctaatcccagcactttgggaggctgagacgggcagatcacttgaggtcaggagcttgagaccagcctggccaacatgatgaaaccctgtctctactaaaaatacaaaaaattagccaggtgtggtggtgggtacttgtagtcccagctactcgggaggctgggcaggagaactacttgaaactggcagacagaggttgcagtgccgagagcgcaccactgctccagcctgggcaacagagcaagactccatctcaaaaaaaaaaaaaaaaagaaaaatattaataattgaccttggctgtatattaaaatagttacttttatagtagagcacatttctcaaacatgccctgaaaggcttttatcaagctcatataaagttaaagctttgagctaccttttcttggccaataaagtcactgacagtttatgtaaacattaatttcaacatggctgttgcattttaattatcaaaaatgtttaaaatgctttaagatgacacatagagaacatacacatacatacaaattagtgcatttgtaatttgttaaatttgaaatgaactattaccttgaaatatagtctttaaaaatttttaatggttaaagattaaattgaatgaaactgtagtctaatggtaactgatgatctgaatccgtctctctgataacctcctttccattttgaaaatgtgtcttattatacatggaagctagtaactacgtgaatgctgttggcaggatgagggtctgggtacctcagtctcttgtcctgtttccttcccccaaatccaccattgtgaagttgccaaccccctgccgccttcccctgccaagtacatgttgtcagagtcagccctataatgttcatttcccctcttgtttgtgggattatggatctctgcagaaatctgcatgccaattaacccatttctaaagcagaatccattttgcatgtcacaatcaagatgtacttggcaatctaagacacactgggagactgtaagaggaattaatatagaaaagctcttaattataataacatttggaagaaatttttcctttgttttgtaaagtggctaaggttgtaggagtgtgtggtatttattaccttttaaatgaactgtaaatttgccttagaaatttgtttaaaaggctagcaagtgagacccttgaggatgatcatatactaataaagattaccaaaagaaacttcttgtcctgttaggtcagtgttatgatttaatggttttaattacttaaccaattttaagaattgacaatttttaaaaatatttttttctaccattctaaagtaatgtcttttgttgtgggtttatgtgtaactacaggattttggaacataaacattttgaaggatagtcaatggtatttagtcttggatataaaaatagagaaaatttatagctttatgttattaaaataatttatcacacagagtgatttgaggttttcgcagagtagatttgtttgactcatggtttattagtctggattacttaagaacaatatgttgattttaatgttaattcccactaaatatataatattgataaatacatgtgaaattaatattgtttggaaaatgtagaggacacag

SEQ ID NO: 4035 - DNA, 2068 bp, Homo sapiens
ctgcacagggagtttgtcttgtgcaaacaatttccaaggcagcgttttcttccctgcctgggagtgcagggctcagcgccttcactttggaactgactcagagacctaaagaagcccacctggccagcgggaaggggggccgccgccgcctcccggttttgggcagccctggccagctccctgtggccttggaggacttccaccgggcaggcgttcccatgatgccaggctaccaggcgcgggggattcctgcaggccggcgctgcttttcttagaaccccctttctagaaaagtacacctgggggttttgcttcaaagagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaa

SEQ ID NO: 4036 - DNA, 748 bp, Homo sapiens
ctgcattgttagatttgtgattctgcactgttcatttcagtactatctaatataaaaattacatgtttaaatgttttataattaaaaattgggctcaggttaaaatattttcttttggagataccttttgttgtggtcttgtcacaggaagggtcctctactctgcatccttctccattaagcagggacaactgcattattggcaagcgctaagcaacatggagaagcagacatgtttgtgaatcgcaaagtgaaatctgattctctccaactatggatgagtgagagtaggatatttcagtggctggttttaaaacatgctttacttttttgcttcctttgcctaacaacctgtttgctttggggttggcgacaattgtctcagagaagctgaatgaatattttaaccgatgtaatgggtcataagtctttgaacataaaatgggtgtgatgcatgttttaaatgccaaatgatacacttttgggaaaatatatgcgatttgtaatacaacacacctagaaaacttcagaggtgccataagttaatagtgacatcaccggattatgaatacttgagaagcatgggccttttaaaagttgtatgtgagttttaagaggccttgaattaatctgtaccagacataaatgagcatattctgatgtactctttggatctgaactcatcttcacagatgccttcaattaagttgcagagttctgatggagagatatttgaagttgatgtgga

SEQ ID NO: 4037 - DNA, 2329 bp, Homo sapiens
gtggccagcgagggcagcgttcgccgcccctcaggccccgtcccggcgccgcagccgcctgcgtttcggtttgtgagcaggcccggccgggccaggagcgagagcgagactctggagcggtcgccgccgcagtcgcccgggccgggaaaggcgggcgatgcccccaaccgccgctcgggccatgtccgaggggcgcgcgtgttgtcgccgccggggcgccgtgcccgcctgtcgtcccccgggcccagccgctcgtccgaggcccgcgaggagctgcgccgccacctcgtgggcctcatcgagcgcagccgggtggtgatcttcagcaagagctactgtccccatagtactcgggtgaaagaactcttttcttctttgggagtcgaatgtaatgtcttggaacttgatcaagttgatgatggggccagggttcaagaagtgctgtcagaaatcactaatcagaaaactgtgcccaatattttcgtgaataaagtgcatgtaggtggatgtgaccaaactttccaggcatatcagagtggtttgttacagaagctccttcaggaagatttggcatatgattatgatctcatcatcatcggtggtggttctggaggcctttcatgtgcgaaggaagctgccattttgggaaagaaagttatggtgctagactttgttgtcccgtcacctcagggcacatcctggggtcttggtggcacttgtgtaaatgtaggttgtattcctaagaaattgatgcatcaggctgcccttttggggcaggcattatgtgactcaaggaaatttggctgggaatataatcaacaagtgaggcacaactgggagacaatgacaaaagcgattcagaaccacatcagctctctaaactggggctacaggttgtctctgagggaaaaggctgtggcctatgtcaattcctatggagaatttgttgaacatcataaaataaaggcaaccaataaaaaaggacaggagacttattatactgctgcacagtttgtcatagcaacgggtgaaaggccacggtatttaggaatccaaggagataaagaatactgtattactagtgatgaccttttttctctgccttattgccctggcaaaacattagtggtgggtgcctcttatgttgccctggagtgtgcagggtttctggctggctttggcctagatgtcacagttatggtacgctcaatccttctccgtggcttcgaccaagaaatggcagaaaaagtgggttcctacatggagcagcatggtgtgaagttcctacggaaattcatacctgtgatggttcaacagttggagaaaggttcacctggaaagctgaaagtgttggctaaatccactgaaggaacagaaacaattgaaggagtctataacacagttttgttagctattggtcgtgactcctgtacaaggaaaataggcttggagaagattggtgtcaaaattaatgagaagagtggaaaaatacctgtaaatgatgtggaacagaccaatgtgccatatgtctatgctgttggtgatattttggaggataagccagagctcactcctgtcgccatacagtcaggcaagctgctagctcagagactttttggggcctctttagaaaagatatatcatactttgttctggcctcttgaatggacagtagctggcagagagaacaacacttgttatgcaaagataatctgcaataaattcgaccatgatcgggtgataggatttcatattcttggaccaaacgccggtgaggttacccaaggatttgcagctgcaatgaaatgtgggctcacaaaacagctacttgatgacaccattggaattcaccccacatgtggggaggtgttcacgactttggaaatcacaaagtcgtcaggactagacatcactcagaaaggctgctgaggctaggcctgctgctgtttagttctccttgtcatattctcatttctctcaaagataagaatgctctcggataaaatgagcctgtgctcatgacagctgctctgttactcagggaccagtgcagggctgtcttacgacacttagatgagaaagtagacaaggaaagaggacagcagtgggcatctgccttgtggtcttgctgacagcgagaagcagtgggactgcttccttgacgccttagcttggagccccgttatgaggtgagccaaggctgactctcgcaagccaggactgagcttccctcggaaagacctttgagtggcaccattcacctaagttagcttttctggtcgctattgtttttatcccctttgctttgttgtttctgtgaaaatatatt

SEQ ID NO: 4038 - DNA, 1554 bp, Homo sapiens
ctgcatcctactgctattttcattttatcgatggaatactttgaagcacgaaaaatcattatatcttgaaataatttttaaaataatccaataacaaactcagaactactgaagaataataaagaatatgccgagtttctacattgcaaaggaaagaaatttacagattttgatgaagttcgccttgagattgaagcagaaacagatcgcgtgactggaatgaataaaggcatttcctccatacccattaatttacgagtctattccccacacgtgttaaatctaacccttattgatctacctggaataactaaagtgcctgtgggagatcagccaccagatatcgagtatcagatcagagaaatgattatgcagttcatcacgagggagaactgtctgattttagctgttactccagccaacactgatcttgcaaactcagatgcgctgaagctagctaaagaagttgatcctcaaggtctgagaaccattggagttatcaccaaactggaccttatggatgaaggaacggatgccagggatgttctagagaacaaactgttgcctcttcgcaggggttacgtgggggtggtaaacagaagccagaaggacatagatgggaagaaggacataaaggcagccatgctggcagagaggaagtttttcctttcccacccggcttacagacatatcgctgaccgaatgggaaccccacacctgcagaaggtccttaatcagcaacttaccaaccacattcgggataccctaccaaacttcaggaacaaactacagggacagttgctctccatagaacatgaagtagaagcctacaaaaatttcaaaccagaagacccaacaaggaagaccaaagcattgctgcagatggttcagcaatttgctgtggactttgagaagagaattgaagggtcaggggatcaagtagataccctggaactctcaggtggtgctaaaatcaatcgtatttttcatgaacgctttccttttgagatagtaaagatggagttcaatgagaaagaattgcgaagagaaataagctatgcaatcaaaaacatacatggtatcaggacagggttgtttactccagacatggcatttgaagcgatagtcaagaaacagattgtaaagttgaaagggccttccttgaagagtgtggatctggtaatacaagaattaatcaacactgtgaagaagtgtaccaaaaaactggcaaacttccccagactctgcgaggaaacggaaaggattgttgctaaccacattcgtgagcgagaagggaagacaaaggaccaggtattgctattgattgacattcaagtctcttacatcaacaccaaccatgaagacttcattggcttcgcaaatgctcagcagaggagcagtcaggttcacaagaaaaccacagttggaaatcaggtgattcgcaaggggtggctcaccatcagcaacattggcatcatgaaaggcggctcgaagggatactggttcgtccttactgcggaaagcttgtcctggtataaagatgatgaggaaaaa

SEQ ID NO: 4039 - DNA, 3107 bp, Homo sapiens
gtgcagaaccgtttggttttcccgaggggtaggcagaatttccaaccccacgagctgctccctctttccgcaaacctcctaaccccggggtttttccataaatgtgtttacttcgtccacgccagcctgcgaagttccaaaatggagtctgggccacgccggcgttctgggcacgactacggtctcttgaaaagatttggaattgaccatgtagataatctctgagagcagttcttaaagtgtaatccagaaccggtggaacttgctagaaacgcatattcttcggaccccctccaaatctgctgaatctgagattgtggaggccattcaatgtcccttcttcaggaatttggaaaaaggatggagagatctctctgagctagactcttcagtggaggaaatgttacaactcatggacagtggcattaccatctgccttaggaacggagcagcctctgtcttcaagaaaaaagaatggagcacacaaggagaagaaaacaagcaagacagtaaactaaaaaagctgagtgaagacagtttgactaagcagcctgaagaagtttttgatgtattagagaagcttggagaagggtcttatggaagtgtatttaaagcaatacacaaggaatccggtcaagttgtcgcaattaaacaagtacctgttgaatcagatcttcaggaaataatcaaagaaatttccataatgcagcaatgtgacagcccatatgttgtaaagtactatggcagttattttaagaatacagacctctggattgttatggagtactgtggcgctggctctgtctcagacataattagattacgaaacaagacattaatagaagatgaaattgcaaccattcttaaatctacattgaaaggactagaatatttgcactttatgagaaaaatacacagagatataaaagctggaaatattctcctcaatacagaaggacatgcaaaattggcagattttggagtggctggtcagttaacagatacaatggcaaaacgcaatactgtaataggaactccattttggatggctcctgaggtgattcaagaaataggctataactgtgtggccgacatctggtcccttggcattacttctatagaaatggctgaaggaaaacctccttatgctgatatacatccaatgagggctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgaggaacagcaacgagaattggaagaggaagaagaaaattcggatgaagatgagctggattcccacaccatggtgaagactagtgtggagagtgtgggcaccatgcgggccacaagcacgatgagtgaaggggcccagaccatgattgaacataatagcacgatgttggaatccgacttggggaccatggtgataaacagtgaggatgaggaagaagaagatggaactatgaaaagaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttttgaaaaatctaagtttagaagaactacagatgcggttaaaagcactggaccccatgatggaacgggagatagaagaacttcgtcagagatacactgcgaaaagacagcccattctggatgcgatggatgcaaagaaaagaaggcagcaaaacttttgagtctaatttcctctctgtttttaactattctggagaccaagaaaccactaggaattgaaggaatatttggatatttttaatcctaagattttgccctacaattaggcagaggtcaaaaagtgacaatggtacatgcccaggtaaattcccaaaaggcagaattgacagttgtatctgctgtgcattcactctaagatgaggagaacaaaagaagtgtattctcttgttctgtcagctgcataccagtaataaaactgttatgaaatggattttcaaggtctctaaaccttgaaaatccaaagctattgttgcattgtacagcactgaagggctttatgttacaatattctttattcctatctagtatactaggctatttattgtatccccttaggtaaacttatttatttatgctattttgctttgtttcattttttaaggacaagatcaggatagctttggtgaaggtagggtcatattaatatgatgataatgtgcaaccaatttatactttctgcagggagctatggggtacattccttgatttccaggatagtttttcaaataggaaagcaataatggcagtagttctcaaatgggctaggccttttttatattgaagcaataattccatttttaccctttgaaattttgtttttttgatttttgatgtttggtacaaatagaactatatatatttaggtaaaatagatctatcgtgtttaaaaccaaagaaatcaatggaacccttgcacaaaaaagtgtgataaatatttttaaataaaaacttaatacaaatgtaatttgttaatattgtttcatgttttatgtgtagatctaatagctgaactgattcaaactgtaataagctcatcaatttcatttctatgaaaatgtgctctgttgtcacaggatgtttctgttgattttattcatttcctgggaattggtaaacatcatgttcctgatgataacccagtagcaaaaacatttgtactgagtggtacaagccttggggactgaaaaaaaaaagattaaaaccattaaaaagaaactcatttttacgctgaatgaacatttatatgattgcattgggaccagtcatttcctaagctacatatggccatcttgacagtgttttttcttt

SEQ ID NO: 4040 - DNA, 2522 bp, Homo sapiens
agagcgtctgcttgaaaatggatcctcacttcttcacttggatataataatatagactgccgacattctgggaactgatcagtcttccagcttccagtgtggtgccctccctcaattgtgctgagtgtcccccaatccagagatattctgtaatttcttcctcagaaagaaacaaaacaaaattctgatcttcccagatgaagataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatt

SEQ ID NO: 4041 - DNA, 5033 bp, Homo sapiens
ttgttctttcctggccttgtggagtttcacgttttttattcagttaaagattcaaggtactcctaagcagatttctgaagctctttttccatgtaattccctcctctccagaattctgccctacaaattccaaccgacttggcctaccccaatttcgtcaactccaatctctgtcttttcaacccaggagatcctaggtttccatatgatttcctttcatcgcaccacagactggaaatcgcctctgggcaaaagggcaggatgatatacggctccttttatttcttttctctcaggaaacactgacgggaacacacgtgccggtgctaccctccagtgactggactagatccttgcgcaacttcaacccgcgctagctccgcctacggccggccacgccccgtcttctcaccggcgcgcctccctcttgttcgtcctccctccccctgtggactgcggcgctggcgttccgcgcacgccggctcactgcgcctgcccggcgtgtggacgccacacgctcccggaagtgggaggtggccgctggagtttgtgtggccgccgccgcgggaacgcgagcccggtaatttttcaacggagaaaggcgaggctttcgggctctgcagagtgagagttagcaagtgtccggctccagcaactctcctctggcgtgacagccggcatggaggatccacagagtaaagagcctgccggcgaggccgtggctctcgcgctgctggagtcgccgcggccggagggcggggaggagccgccgcgtcccagtcccgaggaaactcaacagtgtaaatttgatggccaggagacaaaaggatccaagttcattacctccagtgcgagtgacttcagtgacccggtttacaaagagattgccattacgaatggctgtattaatagaatgagtaaggaagaactcagagctaagctttcagaattcaagcttgaaactagaggagtaaaggatgttctaaagaagagactgaaaaactattataagaagcagaagctgatgctgaaagagagcaattttgctgacagttattatgactacatttgtattattgactttgaagccacttgtgaagaaggaaacccacctgagtttgtacatgaaataattgaatttccggttgttttactgaatacgcatactttagaaatagaagacacgtttcagcagtatgtaagaccagagattaacacacagctgtctgatttctgcatcagtctaactggaattactcaggatcaggtagacagagctgataccttccctcaggtactaaaaaaagtaattgactggatgaaattgaaggaattaggaacaaagtataaatactcacttttaacagatggttcttgggatatgagtaagttcttgaacattcagtgtcaactcagcaggctcaaataccctccttttgcgaaaaagtggatcaatattcggaagtcatatggaaatttttacaaggttcctagaagccaaaccaaactgacaataatgcttgaaaaattaggaatggattatgatgggcggcctcactgtggtcttgatgactctaagaatatcgcccgaatagcagttcgaatgcttcaggatgggtgtgaactccgaatcaacgagaaaatgcatgcaggacagctaatgagtgtgtcctcttccttaccaatagagggcactccaccaccacaaatgccacattttagaaagtaacaacagttttgtgtgtggatcattccaattgaagttgctatgaagaggtagcagatgaatctcattgaattagtcctgtagtgcaaactttaagcaccttaaaacatttaaaatcttattacaggtgatagagatagatacatgtatgtgaacagattttgtaggaaggcatactgaattctttgtcaccagcacttttgatatgaacagtattcgttacatagtaacagttcctgcttacaactgaattttataatttaaggtgttcaagatatattctttttggttttaaaatgcaaaatcttattggctgttctgttgaatgtcatatcttactggtgtttaaatatgtaatgtgtttctttattaacatcactagatgaaaccatatcttaaaatgcagaaatgattggaaggtagatcttatctagcctttggatttcaagaatatcatagtccttttgattttcaaagtttatatgtgaagttcaccatgtatgtggtgaatttcgtaaggtacttggtatacatatctgcctatgtttcttttcaactcataattggaagaattatgatggattatagggtttggttaaaaatccagttactgaaggaattaatgaaaacgtagaagaaagtactaaaaggaatatcataagggctgtagctcaaacttcataatacataaatcactggggtctttttggatttggttgtttgattcgccttccttttttgacatatgtatgccttaattcttaaatctgagggaccatgctttgaaatagactgaaaattaagggtcaccacctaattttactttgtattcagtatcgtaagtgaggttaataaagtcaatactttctaccatatattacgtttttgttattaaaaaacttcattggccactagtgaagttagtcaataaaagacttgtttttctgattttacatagtaaatggctgctaagtattgagtaattcttaactaattctaaaaactaaaatgtgcatttcgacttgataaggtaaaactcttatctagaggctaaacccatgtattttcagaattgaatttttctccttgtagctttcagggaacaatttcattgacattgcttgcttcctgccttttaccttttaataaaaattgtgatgctactttattctaaagatttatattttataaccagatgaatttcctcaaaggtttccaaacctatatcatatagggtgaaaagcaggaaagtagacatttttcttggcgtgggaattctctacatagggcagtagatttcttaagccaatgaatttctgcttttcagcagtagtcatataatcagtatcataaagaataatgtgtaaataacagaaggcatatgagagtgtggtgttcctagatgaactgttacagattatagtaaaataaggaaatctaagtgctttaagtttatacagttaactcttaggataagagggatgtatgctgagatgtttgtgcatcccagatagcactgtacaataacctgtaaagtattactgaatactgaatagctgaaactgcaattggaaaatctgatgatgacgaggaaatattacgtttccagtttttttagctctatctgctaatttctttgcctgttttcactttcgccaagtaccaacaagctcatgttgtatttctttttaagaacttcaacattataagctctcagtaccctattttgttgttgttgttgtttgagacagagtttttgctcgtctgccaggatggagtgcagtggtgcgatcttggctcactgcaacctccgcctcctgggctcaggtgatcctcttgcctcagcctcctgagtagctcagattacaggcgcgtgccaccacacccgcctaatttttgtatttttggtagaggcggggtttcaccatgttggtcaggctggtcttgaactcctgacctcaagtgatttgcccaccttgacctcctacagacgtgagccactgcgctcagccatagattttactgtcttaacccattttaattcctctgttgagtctctgtcctcccctccaatttgatttgggattttgctgatgagatgatactaaacattgagagtactgctttttactctgacttttattgtgttgtctttgaaagacaaatagtacaactttttacaaggaaacacgtaagagatggatgtccatgaaaacaatattagtatattctattattgtttcttattaatagttacttagtatttacaaacaatttattattagctgtgttaacttttattctatgcttcatatgctctgacattgacatagtggatttctgctgatttttttcaaatccgcaatctttataaccaactgaagtatataatagagcattacattttatctttatttgtgttctgttggatcaagtatttaacatttgctctgaaaaaaatgtttttgtgatgtgtctttgttgccttgagatagatccatttatcctgcctcctagggagaagtttctgcctggattgaaacaaaaaaacacaggcgtcacaagcatgttacctattaagagagagagggtatctctgaagactaattaaaatggtaatttttaaaaagatgtgaccagttgacttttagtatatcatcccaagtattatccccaaaatgataatgcaaaacagaataatttggagaccaggagaaaaactggtatgattactggggaggggaagaagcacaggtggtcaagataataatgcatgtttggcctcagctgtagttgccaaagaaactacctgcctcacagatgagcacgcacgggtgcattgtcaaagtctgagaaggatgtattgtactttgaaggaagactttccatttctaagctaccatggagaagtatatgctcctcgagaccagagactgtgacttctgcatctttgattccagcgacatatgataaaatgttttgcacatagttgaatccagcgttgatacatgaaggacagcattacatcttttttctattatacttagaaatttcctctttgttctgcaccaccaacctgtatatcaagcctccttgccccacaaagcttccaaagcccgtaaatttgttaatctagagcaggggtcagcaaactaccacccatgggccaaatctggctgctgcctatttttgtatggcctacaaactatggtttttatattcccttttgttaatggctcaaaataatattttgtataatacgaaaattacgaaattttagtttctctaaataaagttttggaaagaa

SEQ ID NO: 4042 - DNA, 1373 bp, Homo sapiens
gctgctggggctcggcggggccgtgtctggtctgcaaggcgcgcgggctcgtggggggttggctggggagcccacgctgcctggcgactcgggccaccgaatgtgagaccgagtccctttatgtcaccagcgcacacgctgatttgaaccctgcttcgacgtgtgtgtcatggcttaaaaatagctgctaatctgtcaacctgtcttgggcagaaacagcggcggcgacagcagcaggagcgtcatggccgtggcgctgtctgcgccggcgatccgcctttcggactgaggcccagcgcagcgcttgcaaagagagccaaagagctgagcaaaaggagctgctgcagcttgaagaaaaagccacccctgaaggctcctgccagagccaggcttaccttctctccctcgagaatcttctcccgaaggaccagcccagggaagggaagcagctgctctggactcactcaagtgtgtctcacaccccttcctcttccagcagcagctacctggcaactgaacccatcatcaccacagccactcctgcagctgccacggtttctgccacctctaagatgtgccctggtaactggctttgggcttctatgacttttatggcccgcttctcccggagtagctcaaggtctcctgttcgaactcgagggaccctggaggagatgccaaccgttcaacatcctttcctcaatgtcttcgagttggagcggctcctctacacaggcaagacagcctgtaaccatgccgacgaggtctggccaggcctctatctcggagaccaggacatggctaacaaccgccgggagcttcgccgcctgggcatcacgcacgtcctcaatgcctcacacagccggtggcgaggcacgcccgaggcctatgaggggctgggcatccgctacctgggtgttgaggcccacgactcgccagcctttgacatgagcatccacttccagacggctgccgacttcatccaccgggcgctgagccagccaggagggaagatcctggtgcattgtgctgtgggcgtgagccgatccgccaccctggtactggcctacctcatgctgtaccaccaccttaccctcgtggaggccatcaagaaagtcaaagaccaccgaggcatcatccccaaccggggcttcctgaggcagctcctggccctggaccgcaggctgcggcagggtctggaagcatgaggggagggggagagaggtcaggccaggcccgtgggtaggtccctggctcccagctggagataggaggcccaggtggcaggtagcaggaggcccagatcacccatcctcccctggggtcaggagaggccgagccccaggccactgtcactctttgtgggaggggac

SEQ ID NO: 4043 - DNA, 1491 bp, Homo sapiens
ctctccccccgggctccgcccaccccacgccgggaacccacgcgggccactacaagcccgccctttcctacgtctggtccagtcggtcttcctccggcccgggccctggcccagctagccggccatggaagtgaagaaaatatttggaagctctgtgaatacatcaaaaaccatgaccagtatcctttagaagaatgttatgctgtcttcatatctaatgagaggaagatgatacctatctggaaacaacaggcgagacctggagatggacctgtgatctgggattaccatgttgttttgcttcatgtttcaagtggaggacagaacttcatttatgatctcgatactgtcttgccatttccctgcctctttgacacttatgtagaagatgcctttaagtctgatgatgacattcacccacagtttaggaggaaatttagagtgatccgtgcagattcatatttgaagaactttgcttctgaccgatctcacatgaaagactccagtgggaattggagagagcctccgccgccatatccctgcattgagactggagattccaaaatgaacctgaacgatttcatcagtatggatcccaaggtaggatggggcgccgtctacacactatccgaatttacacatcggtttggcagtaaaaactgctgaacttggtctcaagatgtggaactgtggagaaattctaggacatgaacaagctatcctttcatcgaggacagcaaacattatggtacagttggcttggaattatgtctttctcttttaatttgattgagtggaaatctgagtgaatacaaatataaatgaacaacataaaaacttttgttttgacatgtcaaattgaaacttgataaagtgcgtacttgctaagatattcctgtggctcatgcgttacaacacgaggacttaagccagtaatcgtttttgttcagatagaggtgtggaggtagagccagcccctcatgtctgttttggatgttttgtgtctctccagctacattgtaagttccttgagggcagggccatggcccattgctctgtgaatctcaaatgcccataaaaggtgcccataaaatgttttcttgaacatttgaatgtgctgttgtctggaaaggggtaatattgtgagctgaatcagcaataagtattagtctttttggactatggtattgttaaaaagactgcagccctctcagacttgagcgttaattggcttatttatttatggctttaaataaaatcgatttaacgttagttttgttttgaagatttttgtgtcacccttgatgatctgaaatacctaaatatgcctcaattgtagatgagaaccagggctttaaaaaatatttattacatgtgccttctggaagacatcttggttatttggctttaatcatatcattccaaatgaaagatatttggcattacattggcatatagtaccagctctcatgttttcatgattctacttta

SEQ ID NO: 4044 - DNA, 575 bp, Homo sapiens
agtgtcaggctctgggagagaggaagtgatcgctcccggaggagcgcgagccgagcggccggcgcagcgtgagacagcacatcctgcccgcgccggccccgccaccttcgggagccgcctgcaccaacgctgccgccgcccaggagccgccgccggctcggggagcccagttccgccgctgccgagcgcgtccagtctcactctgccacccaggctagagtgcagtgcatgattataactcattgtaaccgtgaattcttggcgtcaagctgtcctcccgcctcagcctcccaaagcactggggttacaggaaaccaacatgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcag

SEQ ID NO: 4045 - DNA, 819 bp, Homo sapiens
ggggccaccgcgacgttgcctgtgggtgcccgcgaaccaacggttagcggtggcaggggctgactgagagcgtctgcttgtgcctggtacctagtacaaacttaataaatgtgtgacgcaagaataaaggaatgaatgaatggaagaatgatataatgccacagaactttcaaagatgggactgtctagttgcaaaaacaagctcagggatcccactgattctactttacgataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaag

SEQ ID NO: 4046 - DNA, 1966 bp, Homo sapiens
ctgcctccgactccccactggactgcatggcgacggcgtgtggtggggcagtcagctaagccatttgcctaaggggctgtcgggcatctgcgtgctggggaccgacagtgtgggtgtgttaggaggatctgtatggagcacattgctgcctctggctaggacagggtggaaagggtggcgtggctacagcctgacccatgggcaccgtcctaccctttgttctgtgcttccgagtgtcagtcatgtgctggggtctgtgggcccatgactcagacggtgagctctgaccttcctgagccagggctttgctgtagttgtgcctggctcaggagctctaggacaaggggaccgctccaggtctgcatctacggtgtggcagggcccctcggcactcttgtgcactagtgtcatctttcccattgaaatgactgtgaggaccagaatgtgcacatgcagatgggcagctacttgtctgccttggccctttattacacaacttgctgggggtggagatgccaccccccggcagtcagagcccctttatgatgtcatggggctggttacatgactgccaaggggtgctgctggccacactgcactagcaagtttgccagatggaggacaagcgatcattgagtatggctcgctgtgaagaaagaaattcgagaggacaggatcatggcttggaaagggtgcctttccctccccagttgcagtcagagacctaccttcacccagcagatccttcccctgcctgggacgacccggggtccactgggagccctaacttgaggctgctgacagaagaaatcgctttccaacctctggccgaggaagcttcgttcagaaggccgcaccctgacggtgacgtcccgccccagggagaagataatctcctctccctcccctttccacagaaactgtggagactggtcagcagcaaccagttttcgtccatctggtgggatgacagtggggcttgtagagtgatcaatcaaaaactctttgaaaaggagattctcaaaagggacgtcgcacacaaagtgtttgccacaacttcgataaagagcttcttccgccagctaaacttgtatggcttccgaaaacggcgtcaatgcactttcaggaccttcacccgcattttctccgcaaaaaggctggtctccatcttgaataagttagagttctactgccatccttactttcaaagagactcccctcacctcctcgtgaggatgaagagaagagtgggtgtcaagtctgcaccaagacatcaggaggaggacaagccagaagctgctggatcctgtctggcaccagcagacactgagcaacaagatcacacgtctccgaatgagaatgaccaggtcacaccgcaacaccgggaaccggccggtcccaacacccaaatcaggagtggctctgctccaccagcaactcctgtgatggtgcctgattccgccgtggcgagtgacaacagtccagtgacccagccggccggcgagtggtcagagggcagccaggctcacgtcactccggtggccgctgtccctgggcctgcagcgctgcccttcctctatgtccctggatctcccactcagatgaattcttacgggcctgtggtggcccttcccacagcgtcccgtagtacccttgccatggacaccacaggacttcctgcacctggcatgctgcccttttgccatctctgggtaccggtgaccctagtggctgctggggctgcacagcctgctgcctccatggtcatgttcccccatctcccagctctgcaccaccattgcccccacagccaccgcacgtcacagtacatgccagctagcgatgggccccaggcgtacccagactacgcagaccagagcacatagagggcagcatttgggcagaatatgtgctggtcaataaatgtgtcagaaaatgagtaattttctgactgcacaaaaaagtc

SEQ ID NO: 4047 - DNA, 2950 bp, Homo sapiens
ggtgttggggggcggggcgagcggctgcctcgcggattcgcgcgggtggtgagagtggccagcgagggcagcgttcgccgcccctcaggccccgtcccggcgccgcagccgcctgcgtttcggtttgtgagcaggcccggccgggccaggagcgagagcgagactctggagcggtcgccgccgcagtcgcccgggccgggaaaggcgggcgatgcccccaaccgccgctcgggccatgtccgaggggcgcgcgtgttgtcgccgccggggcgccgtgcccgcctgtcgtcccccgggcccagccgctcgtccgaggcccgcgaggagctgcgccgccacctcgtgggcctcatcgagcgcagccgggtggtgatcttcagcaagagctactgtccccatagtactcgggtgaaagaactcttttcttctttgggagtcgaatgtaatgtcttggaacttgatcaagttgatgatggggccagggttcaagaagtgctgtcagaaatcactaatcagaaaactgtgcccaatattttcgtgaataaagtgcatgtaggtggatgtgaccaaactttccaggcatatcagagtggtttgttacagaagctccttcaggaagatttggcatatgattatgatctcatcatcatcggtggtggttctggaggcctttcatgtgcgaaggaagctgccattttgggaaagaaagttatggtgctagactttgttgtcccgtcacctcagggcacatcctggggtcttggtggcacttgtgtaaatgtaggttgtattcctaagaaattgatgcatcaggctgcccttttggggcaggcattatgtgactcaaggaaatttggctgggaatataatcaacaagtgaggcacaactgggagacaatgacaaaagcgattcagaaccacatcagctctctaaactggggctacaggttgtctctgagggaaaaggctgtggcctatgtcaattcctatggagaatttgttgaacatcataaaataaaggcaaccaataaaaaaggacaggagacttattatactgctgcacagtttgtcatagcaacgggtgaaaggccacggtatttaggaatccaaggagataaagaatactgtattactagtgatgaccttttttctctgccttattgccctggcaaaacattagtggtgggtgcctcttatgttgccctggagtgtgcagggtttctggctggctttggcctagatgtcacagttatggtacgctcaatccttctccgtggcttcgaccaagaaatggcagaaaaagtgggttcctacatggagcagcatggtgtgaagttcctacggaaattcatacctgtgatggttcaacagttggagaaaggttcacctggaaagctgaaagtgttggctaaatccactgaaggaacagaaacaattgaaggagtctataacacagttttgttagctattggtcgtgactcctgtacaaggaaaataggcttggagaagattggtgtcaaaattaatgagaagagtggaaaaatacctgtaaatgatgtggaacagaccaatgtgccatatgtctatgctgttggtgatattttggaggataagccagagctcactcctgtcgccatacagtcaggcaagctgctagctcagagactttttggggcctctttagaaaagtgtgattatattaatgttccgactacagtgtttactcctctggagtatggttgctgtggattatctgaagagaaagctattgaagtatataaaaaagagaatctagaaatatatcatactttgttctggcctcttgaatggacagtagctggcagagagaacaacacttgttatgcaaagataatctgcaataaattcgaccatgatcgggtgataggatttcatattcttggaccaaacgccggtgaggttacccaaggatttgcagctgcaatgaaatgtgggctcacaaaacagctacttgatgacaccattggaattcaccccacatgtggggaggtgttcacgactttggaaatcacaaagtcgtcaggactagacatcactcagaaaggctgctgaggctaggcctgctgctgtttagttctccttgtcatattctcatttctctcaaagataagaatgctctcggataaaatgagcctgtgctcatgacagctgctctgttactcagggaccagtgcagggctgtcttacgacacttagatgagaaagtagacaaggaaagaggacagcagtgggcatctgccttgtggtcttgctgacagcgagaagcagtgggactgcttccttgacgccttagcttggagccccgttatgaggtgagccaaggctgactctcgcaagccaggactgagcttccctcggaaagacctttgagtggcaccattcacctaagttagcttttctggtcgctattgtttttatcccctttgctttgttgtttctgtgaaaatatattttcagttaagaaatgctataaagtagtggttttctagtgcgtgggcctagaattcacacatgctcactggtgaacagtgtctgtgggctgctgtgggctgcatttggatagctgtctgcattagcaggaagctgtacacactgtgtagggttagtcatctcttttcttttttgaggcacatttaacctactgtcaaaacgctgactcatgcttcaccctcacactcactacttggtggtgataaccttgaagctattctcccctaattaatatctcgagactgagcaaaatatctcatgtaagataaaagtacttgaattgctttttcatgttcatcttaatagtattatttccaaaagtttttaatactgtattatgtgaaatctaactaatttatctgtgaaataattccatcacagtctgtttaatgatgataaagttccataaatgaatacaggt

SEQ ID NO: 4048 - DNA, 949 bp, Homo sapiens
ggccgttgttggtcgagctggcgggtcccgcgggccaggccgtggaggctttggtgtcaggatgatgctggcttcataaaatgagttacggaggattccttctttttatattgattggaatagtttcagaaggaatggtaccagctcctctttgtacctctggtagaattcggctgtgaatccgtctggtcctggactttttttgagctcctgaaggaagcactaaacatggaaaggaacaaccggtaccagccactgcaaaaacatgccaaattgtaaagaccatcgatgttaggaagaaactgcctcaactaatgagcaaaataaccagctaacatcgtaatgacaggatcaaattcacacataacgatattaaccttaaaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcgagtatggtgttatgcttgcagcaaagaagtatttttggataggaaattaggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctc

SEQ ID NO: 4049 - DNA, 4014 bp, Homo sapiens
caaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggagtcgcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgtactttaca

SEQ ID NO: 4050 - DNA, 915 bp, Homo sapiens
acatctctgccttctcattttctcttaatttttttctttttttggcttcttggtattctttgctttcttggagctcgtcacacatttaggaggatttttgtcttttctggaatttttagttgttttttggtgggagggtctgtcagtgcatctagtcctccacactatggaagcagaagttggtttaaattcactttaaaaattgccttctgttttatcaattctgcctaaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttg

SEQ ID NO: 4051 - DNA, 580 bp, Homo sapiens
atttgtggcaggtggggcaggctggtcacctggagcaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcaggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgctgcggctgctggaca

SEQ ID NO: 4052 - DNA, 389 bp, Homo sapiens
gaagtggccagttcaggaggcggaccccccgagggcagcgctgcggggccgttttccggccctcctgacgcgacactgcccctctccgagagctgagaaggaaaagaggagcttgcggaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaac

SEQ ID NO: 4053 - DNA, 628 bp, Homo sapiens
tgcaggtcgggtggcaccagctgctgtcctgaggctgcactggagccgcccgcaggggcttctgccgggctcaggccttctctccagctcgaggctcagtttggcccaggctttgcctgctgggcgtgagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgaggccctgtctcccagccactttccctcctggcactgcc

SEQ ID NO: 4054 - DNA, 2771 bp, Homo sapiens
tttgggcgcttcgctgatggtgtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatga

SEQ ID NO: 4055 - DNA, 4292 bp, Homo sapiens
cgcttcgctgatggtgtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagttacaacctgccatattcattcatccagtgatgatgaaattgactttaaagaaacgggtttctcacaggattcttctttgcagcaaatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaa

SEQ ID NO: 4056 - DNA, 558 bp, Homo sapiens
attctgaggatcactgtcctttagtgatgaagtgggtgctgttcctggacataaaggcagacctgtgcttgacatggattgatctgtcttctggcagtgaagtgcaggcatgaaccttggtcagccccacactcttctccatccgtagcccatgtactagagtttggacttggaccgaagtctggggcagctccctaattactagggtgctgaaggcgtgattgtgccagtcgactgcgagttccttccgcagcttgtatcgttacccactcctgcaggtgctgctgctgcctccactgtactcagacccaggtagcacaggattgtccatcctccagcagctcagtgcaacggtgtgaactcagcctgtttcagagcctccacaccatgacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctct

SEQ ID NO: 4057 - DNA, 3577 bp, Homo sapiens
gggccctcacagaaggcggtggcgggcgggtgcagcgagtttgtccccttgcccgcacactgcttggcctctgtacttaagtgcggtggccgcctgcctcgctggagcttctctgccgcagccatccgtgctgcttgggacgggccggggcgcgaaggcggtcgcatccatcgctctgccctcctgcttctcttgtgtaatcagctgcctatttggaaattgggcagggtttgcgactggatgctaatgtcactgactagttttcagcctaccatccagaagtaacatgttcccagctttggaaacgcacctaaagcagactattcctgatccttatgaagactttatgtaccgtcacctccaatattatggctactttaaagctcagagaggcagtttaccaaactctgctacgcatcagcatgttcggaagaataaccctcaatgcctgttgaatggctctcttggggaaaaagatgatttgataccagacaccctgcaaaaggagaagcttctatggcctatcagtttatcttcagctgtgcacagacagatagaagccatcaacagagactttcactcttgcctgggctggatgcagtggcgcggcctcagctcactgcaacctccacctcccagattcaaggattctcctgcctcagctttccgagtagctgggattacagattcacatatgctgagtttaccacatcttaggagcagacagcttctttatgatgagttggatgaagtaaacccacgtcttcgagaaccccaagagctcttttccattttgtctaccaagaggccactgcaggctccaagatggccaattgaatgtgaggtcatcaaggaaaacatccatcatattgagtgggctccacctcaaccagaatatttctatcagcctaaaggaaatgaaaaggtaccagagattgtaggagagaaaaaaggaacagttgtctatcaattagattcagtgcctatagaaggttcctattttaccagttccagagtgggaggcaaacgaggaattgtcaaggaacttgctgtcacgttgcaaggaccagaagataatactctactgtttgaatcaaggtttgagagtgggaatctgcaaaaagctgtcagagtagacacctatgagtatgaactcaccttgcgaactgacctctacactaacaaacacactcagtggttttattttcgtgttcagaacaccagaaaagatgctacctatcgcttcaccattgtcaacttgctaaaacccaagagtctttatactgtagggatgaagccactcttgtactcccaattggatgccaacacccgcaatattggctggaggagagaaggaaatgaaatcaagtactacaagaacaacacggatgatgggcagcagcccttctactgtctcacgtggaccattcagtttccatatgaccaggacacttgcttctttgcacacttctacccatatacatacactgatttgcaatgctacctcctgtcagtggcaaacaaccctatccagtctcagttctgcaagctccaaactttatgcaggagcctagcaggaaataccgtttacttgctcaccatcaccaacccatcccagacccctcaagaggcagctgcaaagaaagctgtggtcttgagtgccagagttcaccctggagaaagtaatggctcctgggttatgaaaggctttttggacttcatccttagcaactccccagatgcccagctcctcagagatatttttgtcttcaaggtgcttcccatgttaaatccagatggtgtgattgtggggaattatcggtgttccttggccggaagggatttgaacaggcattataaaaccattctgaaggagtctttcccttgtatttggtacaccaggaacatgatcaaaagacttcttgaagaaagagaggttctgttgtattgtgatttccatggccacagtcgtaagaataatatcttcctgtatggctgtaataacaacaatcgcaaatactggcttcatgaacgagtctttcctttaatgttatgcaaaaatgcaccagataagttctcttttcacagttgtaattttaaggtccaaaaatgcaaagaaggaacaggacgagttgttatgtggcggatgggaatcctaaacagctacaccatggagtctacctttggcgggtccaccctgggtaataaaagagacacccactttaccatcgaagatctgaagtccttaggttatcatgtctgtgacacccttctggacttttgtgatcctgaccaaatgaagttcactcagtgtctagcagagcttaaggagcttttacgacaggaaatccacaagaaattccatgaacttggacaagatgtagatttagaaggaagttggagtgacatctctttgtctgacattgaatccagcaccagtggctctgacagttctctctcagatggtcttcctgttcacctagcaaacatagcagatgagctgactcagaaaaagaagatgtttaagaagaaaaaaaagaagtcacttcagactaggaaacagcgaaatgagcagtatcagaaaaaaaatttgatgcagaagttaaagttaacagaagatacctcagaaaaggcaggatttgcttctactctgcaaaagcagccaacctttttcaaaaactcagagaattccagttttttaccaatgaaaaatgaaaacccaaggttaaatgagacaaatttaaatagaagagacaaagacacccccctggacccatcaatggccaccctgattctgcctaagaataaagggagaatgcagaataagaagccaggctttacagtatcatgctctccaaagagaaccataaactccagccaagagccagctccaggtatgaagccaaactggcctaggagcagatatcctgccacaaagagaggctgtgctgccatggcggcatacccatccttgcacatatacacatacccgtaggtgagcctgggctgtgccacacaagcacttcatcgggggttttgagattagacacattttataatgggggagatgtatgactgggaactgcatttacttgtggtatactgtgttgtgcactcatgcactgaccttacactttgtacttacactgtgggcatgtggtcaagatgcatacctcatgaattcaactattttttcataaaatgaaattttattatgatgtgtaaaaatgctttatcagaaactgaagtgtgttctcatggcacacttcatggcagcacagatatacctcattttaaccaatagatattctctctaaaattatgtgcaaatcaatttttaaaaatcaaaatctatgttaaacacattttggcagtgtgctataataaaaaaaagtgttgtgtcaaagctttctagtgacggtcagtcctactgctgtatgtcaggtttgctcacaatgaggtattcccacatagaaataacaatgcatgtattacccagaatttaatgttgcgtaccttatgttcaatgaggttttgtaatttttttaggctgatgattaaaattctttctctctaa

SEQ ID NO: 4058 - DNA, 1830 bp, Homo sapiens
aaagcgttacttccggcggaaaaggacgcgggagattcgattggaaggctgccggcgtgctactgagttcggccggtccgagtcactgtgcgtcgcctgggcccgttcctggtcttctcccccagggtcttgctctgtcacccaggctggagtgccatggcatcatcatagctcactatggccttgatcctcctgccttagcctcccaagcagctggtattacagatggagttttgctcttgttgcccaggctgaagtgccatggtgcaatctcggctcactgcaacctccgcatcctaggttcaagcaattctcctgccgcagcctcctgagtagctgggattacaggcaccccccaccatgctcagctactttttgtatttagtggagatggggtttcaccatgttggccaggctggtctcaaactccctacctcagaccacggtgtgaacacatgaacagaagacgaaaatttcttctagcctcagtacttgctctccagaattcaagttttatatatccatcatgtcagaagtgcttctctaggataatcctggtctccaaaaggtctaattgtccaaaatgtggctctactggtgaatctggaaatgccaattacagatacaaactttccttaaaagttgcagaatcaaacaaattgtttgttattactgtatttggaagttgcttagatacattttttggtcttactgccactggtttgcacaggtacattcaggatcctaataaaattccagaaacactggacaatgatacaactcagaatctattaactaaagcagttgaaacttgctttgttggacaaagctttatttttggagtgacgaattttgaaaaccaacctggacaaggttcagatgccagtaacttcttacagcaatgctctgaccacaaaagaaaagccaaagcactagtggcttgccagattgttctaccagacccagccacccaagatgctaaaacaaaataagaccaaggggaagaagatggctggggcccctgctgtcatgaagaagcaagaagccaagaaagtggtgaatctcccctgtttgagaaaaggcctaagaattttagcactggacaggacatccaccccaaagggatctcactcactttgtcaaatggcctcattatattaggttgcagcagcaaagaactatcctctgtaggtcactggaagtgcctcttgtgattaaccagtttacccaggccttggacctcctaacagctgctcagcttcttaagctggcccacgagtacagaccagtgacaaagcaagagaagaagcaggaattgttggcccatgctgacaggaatgctgccagcaatggagacatccccactaagagttcacctgtccttcaagcaggggttaatactgtcaccaactcaatggtgaacaagaagtctcagctggtgctgactgcacaagatatggatcccatcaagctggttgtcttcctgccagccctgtgttgtaaaatgggggtcccttactgtgttatcaaagagaaggcaaggccgggaagtttagtccacaggaggacctgcatcattgtcaccttcacacaggttaaatggaaaaaacaaggagctttagctaaactttgggagcttcaggatcaattacaatgacagatataatgagatccaccatcaatggggaggcaacatcctgggtccaaaatctgtggcttacaatgccaagccagaaaagacaaaggctaaaaaacatgccactaagcttagttaaatgcacactgttgagttttctgtacagaaagataataaaaaattctccttcagcc

SEQ ID NO: 4059 - DNA, 564 bp, Homo sapiens
ctggtgctgctatgggcctgtctgcacctccgtttccctttctgtgcagggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgcacgcctgctgctccaaggactgccccctggcaccacgccccagcgcttggagcagcatgtccaggccttgctgcgggcctcggggctcccagtacagccttgctgtgccttggccagcccccggccagaccgggctctggtccagttgcccaagcccctttctgaggcaggtg

SEQ ID NO: 4060 - DNA, 616 bp, Homo sapiens
gatcagattcaaggtgacacgcaccagcatacacagaaccacagggctgcccgggcccggactgccccacagaggcggcagatgcacacagaggtcagccacagcaccccacatggagggctgctcacccacagaggtgcagagggtgccacctccaccagccaccttgaaggagaaataactttatttggactgagagctggagaatgagaataggacctgagagtatattgggctaaggaggagaggtgtttgagcccagatgagtcatggctggacgacccctccgcataggagatcagctggttctggaagaagattatgatgagacctacattcctagtgagcaagaaattcttgaatttgcccgggagattggtattgatcccatcaaggaaccagaactgatgtggctggcgcgagagggcatcgtggccccactgcctggagagtggaaaccatgccaggacatcacaggtgacatttactatttcaacttcgccaacgggcagtctatgtgggaccatccatgtgacgaacactatcggagcttggtgatccaagagcgggcaaagctgtcaacttctggggccattaagaagaagaaaaaaaaaaa

SEQ ID NO: 4061 - DNA, 1704 bp, Homo sapiens
gtcggccggagcgcgagagccgggacccgggctgttggcggcgcacgccggggaggttgaggcggaggagcgcgcgttcgggcgccgcggacgctgtcctgtagcggtctcgccggcctcggcgtccggactgtggcaccgcgcggggactccccccgcgcccccgctgccaacgttaagcgagggccaaagcccgccgcccgccccccagcatgcgcacctcgtacaccgtgaccctgcccgaggacccccccgccgccccctttcccgccctcgccaaggagctgcggccgcgctcccctctctccccgtccctgctgctctccaccttcgtggggctcctgctcaacaaagccaagaattctaagagtgcccagggtctggctggtcttcgaaaccttgggaacacgtgcttcatgaactcaattctgcagtgcctgagcaacactcgggagttgagagattactgcctccagaggctctacatgcgggacctgcaccacggcagcaatgcacacacagccctcgtggaagagtttgcaaaactaattcagaccatatggacttcatcccccaatgatgtggtgagcccatctgagttcaagacccagatccagagatacgcaccgcgctttgttggctataatcagcaggatgctcaggagttccttcgctttcttctggatgggctccataacgaggtgaaccgagtgacactgagacctaagtccaaccctgagaacctcgatcatcttcctgatgacgagaaaggccgacagatgtggagaaaatatctagaacgggaagacagtaggatcggggatctctttgttgggcagctaaagagctcgctgacgtgtacagattgtggttactgttctacggtcttcgaccccttctgggacctctcactgcccattgctaagcgaggttatcctgaggtgacattaatggactgcatgaggctcttcaccaaagaggatgtgcttgatggagatgaaaagccaacatgctgtcgctgccgaggcagaaaacggtgtataaagaagttctccatccagaggttcccaaagatcttggtgctccatctgaagcggttctcagaatccaggatccgaaccagcaagctcacaacatttgtgaacttccccctaagagacctggacttaagagaatttgcctcagaaaacaccaaccatgctgtttacaacctgtacgctgtgtccaatcactccggaaccaccatgggtggccactatacagcctactgtcgcagtccagggacaggagaatggcacactttcaacgactccagcgtcactcccatgtcctccagccaagtgcgcaccagcgacgcctacctgctcttctacgaactggccagcccgccctcccgaatgtagcgccaggagccacgtcccttctcccttccccgtggtggccccgctccctaaattttttaaaaagacaaaaacaaaacaacaacaacaacacacaaacctgacaagagaaaaacaaacctgaagctgccgagcaggagtggatgcagcctgatcagggtctggagcaaggagccgggctttcctgagctgtggcccggcagggaagatcgcctggacgtggagccagcatcgccccgtgccctcggcgtttgcatttgtaaacttgtggtcttcctatgtgtcagaaacaactgtgtcttgg

SEQ ID NO: 4062 - DNA, 980 bp, Homo sapiens
ctcttcccagcgttcctcctccggccccaggtcaccgccagcacgcgcctgcttcccgtctgcgcgagtccacgcagctccccagatcaagaagctgaggccccaggttacacactaaagtaaatggcagaggcagaaataacacctatgtcctcctgaccccaaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttt

SEQ ID NO: 4063 - DNA, 1780 bp, Homo sapiens
cttgcttccacttcaggcctgcctgaggcacttccactggtctccagttacttgcaaggtcaagtacaacctgcaaggctggttatgaagaagaaactcaaaataacaggagtggcttatggaactacatggagctctggcaggctgccctgagcacgctcaaccccaaccccacggacagctgtcccctctacctgaactacgccaccgtggctgccctgccctgcagggtgagccggcacaacagcccctcggccgcccacttcatcacgcggctggtgcggacctgcctgccgcccggagcgcatcgctgcattgtgatggtctgcgagcagccggaggtctttgcttccgcctgtgccctggcccgggccttcccgctgttcacccaccgctcaggtgcctctcggcgcttggagaagaagacggtcaccgtggagtttttcctggtgggacaagacaacgggccggtggaggtgtccacattgcagtgcttagcgaatgccacagacggcgtgcggctagcagcccgcatcgtggacacaccctgcaatgagatgaacaccgacaccttcctcgaggagattaacaaagttggaaaggagctggggatcatcccaaccatcatccgggatgaggaactgaagacgagaggatttggaggaatctatggggttggcaaagccgccctgcatcccccagccctggccgtcctcagccacaccccagatggagccacgcagaccatcgcctgggtgggcaaaggcatcgtctatgacactggaggcctcagcatcaaagggaagactaccatgccggggatgaagcgagactgcgggggtgctgcggccgtcctgggggccttcagagccgcaatcaagcagggtttcaaagacaacctccacgctgtgttctgcttggctgagaactcggtggggcccaatgcgacaaggccagatgacatccacctgctgtactcagggaagacggtggaaatcaacaacacggatgccgagggcaggctggtgctggcagatggcgtgtcctatgcttgcaaggacctgggggccgacatcatcctggacatggccaccctgaccggggctcagggcattgccacagggaagtaccacgccgcggtgctcaccaacagcgctgagtgggaggccgcctgtgtgaaggcgggcaggaagtgtggggacctggtgcacccgctggtctactgccccgagctgcacttcagcgagttcacctcagctgtggcggacatgaagaactcagtggcggaccgagacaacagccccagctcctgtgctggcctcttcatcgcctcacacatcggcttcgactggcccggagtctgggtccacctggacattgctgcaccggtgcatgctggtgagcgagccacaggcttcggtgtggccctcctgctggcgctcttcggccgtgcctctgaggaccctctgctgaacctggtgtccccactgggctgtgaggtggatgtcgaggagggggacctggggagggactccaagagacgcaggcttgtgtgagcctcctgcctcggccctgacaaacggggatcttttacctcactttgcactgattaattttaagcaattgaaagattgcccttcatatgggttttggtttgtctttctggtcgtcagcgtggtggtggaaacagctgaagttttaggagacagcttagggtttggtgcgggccacggggaggggaccgggaagcgctggggcttgtttctgtttgttacttaca

SEQ ID NO: 4064 - DNA, 939 bp, Homo sapiens
gatttggggcttgggtcgtttctcacaagcaaccggaggcctgcgccgctgccggcgtctcccgggtgggagctcagcgcggaggctggggtctcggccggggacgtgtggggtgtgcccggaccctcccctccgcatcccgccccttaagcagctttaaggggccggagccggcggctatttctatcccaggaaatccccgggccatctgtgaccaacaaaggcccgagcccccccacccccgcgagcccaacaacagggcccaacggcccctggctccggggtggggggatcgggcctggatcggctgccggtgcctgccagtgggggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgcacgcctgctgctccaaggactgccccctggcaccacgccccagcgcttggagcagcatgtccaggccttgctgcgggcctcggggctcccagtacagccttgctgtgccttggccagcccccggccagaccgggctctggtccagttgcccaagcccctttctgaggcagatgtccgtgtcctggaggagcaggcccagaatctgggcctggaggggaccttggtgtccctggcccgggttccccaggcccgagcggtgcgtgtggtgg

SEQ ID NO: 4065 - DNA, 4322 bp, Homo sapiens
cccgctgcctctggaagagaatcgatcttttgcgccagccctcactgagggtagagggaaaggcctcatgagaaatcaaaagagagagagtaaaacggacatgaaagaggaagatgatgagagtgaagagagtaatgaggctgaggaccagacaaaagagcagaaggcagaggaaagaaaaaatgagcaggagaaagagcaagaggaaaatgaagagaaagaggaggagaagacagagagccaggggtcaaagccagcctatgagactcagcttccatcccttccctaccttagtgttctttcaggtgctgacccagagctgggttctcagctccaggaggcagctgcttgtggcactaactatattgaagcgtcttgtgggaaccctcctatcagccacagggaagctggtcagagccagacctcgtgcctggggaatggggatcatgggtgctggcattgtgggtagggtgcctttgcctccctctcacaggcctgcctgtgttactgaccaatgtggagctgggtctagggtgcgaagaactgcaatggctgctgcaacgggagcagctgagtccaccccaggtgcagcctggcttctgtctgtatctcagcaccaccctctccctctgtgccatggaaaaagtgctaggttgtgaactgctaaaggggctgaatgtgttggatctgggcctgaacatggaaatactggaagaacagatgctgcatgaaatcttgtgcagagagtatcctgaactcgagacccgctggcaggacctaaagatcagagccctagatacctgcaaggctgtggaggctgctgaggagcggctgctgacgatgctgctgttccagaatccgaagcgtcagaagccagccaagtttctgcggaacatagtgagggcccaaggaaagctatgccagctgcgtgctcattgtgaagagttagaagggcagaaactacaggagatggtattgtgggcaccctatcgacctgtggtttggcatggaatggccatggtaaaggccctaagccaactgcagaacctgctgccacttttctgtatgagcccagagaactggctggcagtcactaagcaggctctggacagcatgaagccacgtgagattaatcacggggaggacctggccagccatctactgcaattgagagcacacctgacccgccagctgctgggcagcaccgtgactgcactgggccttacccaagtacccttggtgggtgcattgggcgctttggctctgctgcaagcaacagggaaagcatcagagctggaaagactggcactctggcctggactagcagcctctcccagcacagtccacagcaagccagtctcagatgtggctcgaccggcctggcttgggccaaaagcctggcatgaatgtgagatgttagagctgctgcccccatttgttggcctgtgtgcctccctggcaggccactccagtgcttggcaggcttacctgtcactgtcatccacagtgctgggtcctgcacctgggccagggcctgagccactcagcctcctccagaagctgatcctgtggcgcgttctgcgacctgagtgcctggcaggtgccctggcagacttcaccactagcctcctgggtcggcccctggatgaaaacacgtatgctcccaccatgccctttaaacatagtcaggctactcagcccatgctgatcttgttgccaccgcctggccacccctcagccactctgcatcctctgactgtcatccagaaactggctgccaagtatcagcaggggcagaagcaactgcaggtgatagccctgggctctgaagcctgggacccagtctcagttgtggtcagcactctatcccaggctatgtatgaggggcactggctggtgctggacaactgtcatctgatgccccattggccgaaagagctgctacagctcttgctggaactgttaggcagagccaaggtggttgcagacctggaatcagaacagcttttagaccaacctgaaagcaggaatgtaagcactgttcacagagattttcgtctttggcttattgtgcctgcagagtctagtgcttctttgccagctgtgctgactcagcactccatgcctgttttctggaaccagtccctggagctgggccatgttttgattgacagtgtggagctagcccagcaagtactctacatgcaaccccccacccaggcactacctctgctcctcctccatggcctcctgctacaccggcagctctatggaacaaggctgcaggcacacagggggcgctggagtcaagtgactctaacccaggttcttcagacccaagaccagctgtgggcaagtcttagcaatccccgtgctgccatgcaagagctggctggtgagacccttcctctcccccttggagtcatcagcccccaggagagcctggaagagggtgggggtgggatacaattcacagctttggttttggcggtggtggaaactgaaggtactggaactgagagactctaacctcatcttcagcttcagttttctacgggggtcctctgggggacactgaggacagggaggccctgattagcctcacacaagcctgcctgagccccagtagtgggagctgggtccagccacacacacctcagtctttgctggccacgctcatgcccctcccaggtaagcctcactcaggtatctgttttggggtagggaatagtgcaatgcaatgccaccccccacagaaatgtggacagcagtctcaataaaggtatatgagggggtaatattcatactgttatgggggtgatggcagtaaaggctcagaggaaggcctactctctcgagtctagggtggggagagtccatcttgtccctcacccctcacctctatccccaagagctaagggagctggatgcaatggcagagtgcaaggcccagatgcacctactgccctcaccacctgaaccccggctctgcggactgagtgagggcccccaagcctggctgttgcgacgccagagtcgcgctctcttgagtgcgctgcagcggagttcacccgtgtgggttcctgagtctcgaagaggcgcccagcttgcggaaaggcgactgcggcaacgcctagtgcaagtcaaccggaggctggagtcactgcaggatctgctgacccacgtgattcgccaagacgagtccgacgccccgtggtcagtgctggggccaaatgcacggcggcctctggagggcgtcttagagaccgaggctctagaactgagccagttggtgggcacgctacaacgcgaccttgattgcctgttgcagcagctgaagggcgcacccccgtgcccctcccgccgctgtgctgcggtggcccacgctctctggactggccgcctacccttgccttggcgacctcatgcgccggccggtccgcagccgccctggcactggctgcgacagttgtcgcgccgtgggcaactgttggttcgttacttgggcgtgggcgcggacgcgagcagtgatgtaccagagcgcgtcttccacctgtcagcctttcgccacccgcgccgcctgctgctggcattgcgtggggaagctgccctggaccagaatgtgcccagctcgaatttccctggtagccgaggctcggtctccagtcagctccagtataaacgtctggagatgaacagcaaccctctgcacttcagggtatcttcgcgccgcccctcgttcgcggttccagtcccctcgaagtctctaattacacctcgcagttaccccttcttggtgatcttgcccccggtaaccctgctagcttctccgatctcgcttcaccacgacctcctacccgctaacccccacttcccacctgccacctcccagcttcctagccttgcctgaccagcttctgacgcccccaggtggagaatggtccaaatcccacggttccagagagagggctgctgctgatcgggctacaggtcctacatgcggagtgggacccaatagctggagccttgcaggacagtccttccagccaacccagccctctgcctcccgtcagcatcagcacacaggccccgggcaccagtgacctgccagccccagccgacctgactgtgtactcgtgtcctgtgtacatgggagggccccttggcaccgctaagctgcagagcaggaacatcgtgatgcatctgcctttacccaccaagctcacccccaacacctgtgtccaaaggagggtccatgtgtgcagcccacccctgtcttgagcccgtctaccaaaataaagttgtagtgattccatgaaaga

SEQ ID NO: 4066 - DNA, 1917 bp, Homo sapiens
cttccttgcttccacttcaggcctgcctgaggcacttccactggtctccagttacttgcaaggtcaagtacaacctgcaaggctggttatgaagaagaaactcaaaataacaggagtggcttatggaactacatggaggtaacagaggagggtaccaaccaaaggcccttgagcaatcaggatgttggctctggcaggctgccctgagcacgctcaaccccaaccccacggacagctgtcccctctacctgaactacgccaccgtggctgccctgccctgcagggtgagccggcacaacagcccctcggccgcccacttcatcacgcggctggtgcggacctgcctgccgcccggagcgcatcgctgcattgtgatggtctgcgagcagccggaggtctttgcttccgcctgtgccctggcccgggccttcccgctgttcacccaccgctcaggtgcctctcggcgcttggagaagaagacggtcaccgtggagtttttcctggtgggacaagacaacgggccggtggaggtgtccacattgcagtgcttagcgaatgccacagacggcgtgcggctagcagcccgcatcgtggacacaccctgcaatgagatgaacaccgacaccttcctcgaggagattaacaaagttggaaaggagctggggatcatcccaaccatcatccgggatgaggaactgaagacgagaggatttggaggaatctatggggttggcaaagccgccctgcatcccccagccctggccgtcctcagccacaccccagatggagccacgcagaccatcgcctgggtgggcaaaggcatcgtctatgacactggaggcctcagcatcaaagggaagactaccatgccggggatgaagcgagactgcgggggtgctgcggccgtcctgggggccttcagagccgcaatcaagcagggtttcaaagacaacctccacgctgtgttctgcttggctgagaactcggtggggcccaatgcgacaaggccagatgacatccacctgctgtactcagggaagacggtggaaatcaacaacacggatgccgagggcaggctggtgctggcagatggcgtgtcctatgcttgcaaggacctgggggccgacatcatcctggacatggccaccctgaccggggctcagggcattgccacagggaagtaccacgccgcggtgctcaccaacagcgctgagtgggaggccgcctgtgtgaaggcgggcaggaagtgtggggacctggtgcacccgctggtctactgccccgagctgcacttcagcgagttcacctcagctgtggcggacatgaagaactcagtggcggaccgagacaacagccccagctcctgtgctggcctcttcatcgcctcacacatcggcttcgactggcccggagtctgggtccacctggacattgctgcaccggtgcatgctggtgagcgagccacaggcttcggtgtggccctcctgctggcgctcttcggccgtgcctctgaggaccctctgctgaacctggtgtccccactgggctgtgaggtggatgtcgaggagggggacctggggagggactccaagagacgcaggcttgtgtgagcctcctgcctcggccctgacaaacggggatcttttacctcactttgcactgattaattttaagcaattgaaagattgcccttcatatgggttttggtttgtctttctggtcgtcagcgtggtggtggaaacagctgaagttttaggagacagcttagggtttggtgcgggccacggggaggggaccgggaagcgctggggcttgtttctgtttgttacttacaggactgagacatcttctgtaaactgctacccctggggccttctgcaccccggggtgaggcctcctgcctgcctggtgccctgt

SEQ ID NO: 4067 - DNA, 862 bp, Homo sapiens
ctgattggttagtttccaggcccaaaaccagaggtctctcagacatttgtttcaaacggctgattgagggagttcaggggttgggggttggcggttcttgcccagtttagcttgggatcaacagctccaacaacgtgtccaatcaacaacagcttgattgtaaaaagtcctgaatctgctggatgatgaaataattttgaatggataattaaagctcaaagtttcagaatcagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccac

SEQ ID NO: 4068 - DNA, 556 bp, Homo sapiens
atctcttctgcaccttgtgcattgtaggttttggatgcttatttgtttagggtctaggacctggtgcttagcctctcctggatcctgtatatttactgactttccaaattcttttgagtgtggcattatatctgcttcatcttctctttcttggctattcttagtgcccttctcattttactgtcctaatgttttcccatttatactatgaatcattgtgcaccctatgtagagcctgtcattggagattaaaatcagtggcagctctttgattttacagctcagcctcagctgaacataacttctttttttcaaagttccctgtgttgtgaactgagcttgggtgaagtgaaatctttgaggaagctaaagctgtgtgtatttgtggatcagacaagtgcagcaagttaatatcattggcttctgaaggggagagtgaggtgatggctgcgtttaagttggatttccttccagaaatgatggtggatcattgctctttgaattccagtcccgtctcaaagaaaatgaacggcaccctggaccacccagaccaacc

SEQ ID NO: 4069 - DNA, 4199 bp, Homo sapiens
gaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcaggtgagggtgactgttgactagtgaaaaaagggacccatggttcacgactgtcttcttactggcagtggaacgacctgtggaaacctgtgatccattctcattaaataaatctctggattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctctcaagctctcgcctttcctatcagcctgctgccctgggcgttggatcagctgacctggcttatccagtagtgtttgctgctggcttaaatgctacacaccctcaccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggagtcgcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgtactttaca

SEQ ID NO: 4070 - DNA, 1410 bp, Homo sapiens
ctttcaaagccaatttgaataaacaactcttccctctcaaatgggcaagagtaactcttcagcaccatggagaggtccgggcagcgtgttacaacgtgggactgtgaccagggcaagcactctgacagtgcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaac

SEQ ID NO: 4071 - DNA, 540 bp, Homo sapiens
attcccacccctacccaggaccggcagccggagccttgggtccctgcatgggcctggggcgccctgtgccccttcacctcgtcctcgtccagttgactgctgtggcagccggtgctacccgctgtgtccactgcaccctggccctgttctgagcggtcacagcagctggggagaagggccatcctggaagccgggcagatgaggacggaaccagacagtcccactgtggtgggcagaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcaggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggcca

SEQ ID NO: 4072 - DNA, 525 bp, Homo sapiens
gtgctgcagcccgagctcgaggggggagcgccgcctccgcaggcctcctgagacccgggcggctggggacgcagacagacacctgagggagggaagagcgcgcacccaggaggagtctattggcctacccgcagggggaggccgagatggggagactgaggcagatgaatggtgctggaaggaaaccctgaagtggggtccccccgaacctcagacctccagcaccgggggaacaagggctcttgcgttctctcctctcccggtgaagatgcgcagccaggcgaggagcccatcaagtatggtgaactcatcgtcctgggatgctgtgaggaaggaggtgaggaaaccgaggctcagagaggggaagtgactggcccaagggcacacagctgctacaatggttgtctggcaagtggggacaagggccgccggcgaagccgcctggcactgagccgccggtcgcacgccaacggggtgaagccagacgtcatgcaccacatctccacgccgctcgtctccaaggca

SEQ ID NO: 4073 - DNA, 585 bp, Homo sapiens
gcgctcgagtgtgggcggggactgagggaagaagtgaaaatcggactgccaggcgacagttcctccgtttgaaatctcgccggctcctgagcgggccaccgggcccgggctgggggtctggcgggagaaataactttatttggactgagagctggagaatgagaataggacctgagagtatattgggctaaggaggagaggtgtttgagcccagatgagtcatggctggacgacccctccgcataggagatcagctggttctggaagaagattatgatgagacctacattcctagtgagcaagaaattcttgaatttgcccgggagattggtattgatcccatcaaggaaccagaactgatgtggctggcgcgagagggcatcgtggccccactgcctggagagtggaaaccatgccaggacatcacaggtgacatttactatttcaacttcgccaacgggcagtctatgtgggaccatccatgtgacgaacactatcggagcttggtgatccaagagcgggcaaagctgtcaacttctggggccattaagaagaagaaaaaaaaaaaggaaaagaaagacaaga

SEQ ID NO: 4074 - DNA, 568 bp, Homo sapiens
ttcttgctgctgccatgtgaagaaggacgtatttgcttccccttctgccacgatgggaagttttccgaggcctccgccactatgctgaactagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactggaatctccca

SEQ ID NO: 4075 - DNA, 14298 bp, Homo sapiens
atggtcccggaggagaggagggtaggtttgtcttctgatgagacatcatctgattcccttaagtcttggcactccatatgtgtcttggacagcaaagaacagcccttggcctgccagcagaaacagaggcagttcgtgaagccagtgactgagtcagagcagcccacagtgctggaactcctgctagctgagctccgaactctgttctcagctgtgttgcaggacagtagccctgcagcttggcgctatcttcatgcagtactgggtctactgcctccatatcgtgagttgctagttggccaccttgatttgctgcccttcctggagcagctgtactgctgggcaccctgggtccaaacccacctccatctggacctgctaggtgccattgtccaggcctttcctccagacagctctttgttagacagtgcttcccatgctgactgctgtccccagaagcggaggctccatcacaggcccccatgcccagcttgcccttttgtgcaggcccagtggagcaggcagcaagtaaaggaggagctggccacctggctgcgaccattgacactgcctgagctacagcgctgcctgggcattgttggtgctcaggtggccctagaagaggctgtgtggctggatggacttagtctccttcccttggcactggcagcggacatccctgtacggtatgaaagcagtgacactgacaatgcagaggtggagcctgttggaagaaaagagaccaggtctcagcttgactatgaagttcccagggaaaaggccttccaaaagagcagcaccggcttttcacctgagacttccttcctggatagccaggtgatgactgctctgaagatggagagatacctgaagaagatccacttcctctatctcaatgtggctcccagccggtactttaggccttacagcctgatggtggtgccacccgacaaggtgaatcccgagcactacatcttctctccctttgggatcttgcatgtacatcctgtggaaggtagcgagacgatgacactgggtacctggcaccatcactgtgttctctggcagcagctccagttcattccattctttaagtattgcctcttacgcaagtcctttacctgttggaagaagaatgtgagattacaggggctgcatcgactccagaaattcctagagaatcatctgctcttggctgtgccccactttggagctgggctactccatattagcaggcttctgcaggagctacactctgtgtcctggctaccccaggaactggatcggtgctatgagctgctggacctgcagacggctctagccgaggagaagcataaggctctacggctgctccatcgttgcctaaacctctgcacatccattcttcgactggttcacgaggacacataccacatgcaacagtgcctacaggagcgagtacaaaactgtgacaggatcaggacaggccaaggctccatataccttcagagggtacagcacaagcaactggagcagaagctgaagcaagcagaggcctggtggctgcagctgggaaagtttgcccgcctggttgactacatgatttgtcagagcctcatttctgtcttggaagagcagataacctcttttgtggccaacatccttcaagccccaaggcagaaaccctttctctcatcacagctggtctttgatgatcatggtcaactgtctcatgtgccctgtgttgaaaatatgatccagactctaactggaggcctacagtctgtcaagacctctgccttgcaggtagtgcagtctgcagacctgaagacctcctcggattccctgtattctgaagaagaagatgaagaggaggactcaaaagacgaatttctgatgcccaagttccagggccagcccagcgatgctgtgagcatcttctgtggcccgaatgtgggattggtgtggccctggaagtctcacccaattgctggtatcttggaggtccgtggatgtcggctgcggggccaatacttcccccacaattataagcagctggaggaagacctggacaacaaccctaagatccagcaggcactgaatatacaacaggtgctgctggagggcgtgctgtgcaaggtgcaggaattctgcagggaacatcattggataacaggcatttatgaattcctgcaatcctgggggcctcagaagctggaagacatgagaggtggtcccatcaagaactacgtgacgctggtgagccgcctgaatgtttggcaggcccgtgtctccagtatgcctatcgagttgctcacaaaaggcgggttgctgctacttagctgccatgatgtacaggcagagatggaatccaagctgaacagcataaggaaggacattcttgcacacgtgcaaaatgagtgctggaacctcagtcaacaactcatgacagagctcacagatttcatgcatatcttccgaaccatcaactcagatattcatgccattgcacagtgcacccagaagttgaatgaagccaatgaacagtacgtcgagctggaggagcgaatggaatacgtacgggcactccacgaactcatccgcaaccactttagcctctttagtgctgagaatgaagcactggacatctcggtgagaaggcaattcggggagtcacccatccctccctgccctcctcccccacaaccacatctactccactgccctctgcttgccccacagcttctggatatgtgggaggcatttcagtttgagaaaagccaggcttcagagttcctgctcagcaagcgacatgccattatgcccaagctgcagcagctgatggcagcagcattggcagagctggaaggcctgcttgcgaaggccctctccggtccctttatggaccccacacaagatcagaggagtactgagcaccagctcgtctccctagagcgtcagttccagaacacagtcagcgacctcagtgaactgcaccacgcctatgccatcttcactgaggatgagactcctgtgcccttgccaatctgtgggacacgtcctattgtgcagcagcagcgcatatggcacctgtaccgagtcatctccgaaaacatcagcgagtggaagtgcatggcttttgccaagttcagcccagctatggcccaggagaagacagagggctggctgacagaggcagcacggatgagcacaaccctggagctgcacagccccgtgctgcagcactgcatgcgcatcctgggggagtttcgcagctacctgcccctgctcactaagctgggcagcctccacccacagagcctcaactgccagtgtctcctgcgtgcccttgggctgggcagtctccaaactatagaactcctaacgctgggccagctgcttacttatccactgctggagtttgcagatcgaatcaaccaggtctggcagaatgaaaatgaacgaattcatgcccaagagactatacggcggttgcagcggtactgggaagcgcgccagctgcgcctgctcaacttcatcctgcatgtaccctacgagcccccagcctcagagcgctccaagaggcaggtgctccgcagcccccaatgggaggtagtggacaaagatagtggcaccttcatcctctcagattacagcaacctgcaggattccatccaggaaagtcttcaggtgttgtccaagatcttggccatcgaaaagtcaggagatttaaacaaaatagctttggagtgggtggccatcatgcatggcctgggtgccctgctggaggtgtggctgactttccagcagaagtggatttttctgaataaagttctgcatgagatgaagatccagtttcctaatgctgacctgaactctcgtttcaaggtcatggatgaccagtatcgaaccctgatgcgcatctctgtagctgaccccatggttctgtcacttgtagtgcccagtgccgagaggagcccttacttccaaggccagcagctgcaacaactgctgcaagcaggatcggtggagctggagggcatcatcatgagtctggagagcgtgctctatggggtgtgtgctcacttcccccgcctcttcttccttagtgacagtgagctggtagccctgctggctgctcgactggaatcatgcgaagcccagctatgggtacgacgctgctttcctcatgtgcatgctgtgagcttcaggtcttgcccaactggtgagaaaaacacagatgactgggagtcaagcccaaacacacagactcaggtggaggcacttgcagtgctaggggcaggtggggaggaggtgaagctgcagggtccccttcctctgcatccagatctccctaagtggctggcctctctggagaagtgtctgcgcttggcactggtgcacatgctgcagggctgtgtggctgctcgccttgctcgaggcccatctctaggtgaggccctcaagcaactgcccaagcaaaacaagttgtacctgcaactgtatgtccagcactggatcgacttagtccaggccttcccatggcagtgtgtgctggtggcagaggaggtggtatggcgggccgagatggaggaggctctgcttgagtggggtaccctggccatggtctccatgcatatgcgcaagcttgaggtactggtgaattttatgcgggcccagagggcttcccaaggtgggcagtccctgccttctgtccgccagaccagccttctcagtgccctgctggtcatggcagtgactcaccgggatatagcacagctgctggaacagcaccaggtcagtgatctcacagactttcactgggtccgccaactcaagtatcacttgggttcacctcacataatccccaaaagccccctacagagtcttaagactattgcatcttctgaaccctctctgtcaccagcggcatgctggatagatgtgctaggcaggtccttcctgtacaattacgagtatctgggacctagactagggcctctacccagcctactgcctgaacggccagccctggtactattattggccctagaggaggtggcctgtgggaccgtactgggtcctaatggtgtgggcaagagagctatagtgaacagcctggcacaggccctgggccgccagctggtgatgctaccctgctcacctcagatagaggctcaatgcctgagcaactatctgaatggtgccctgcagggtggtgcctggctgctgttggagaaagttcatcagctgccccctggcttgctctctgccctgggccagcgcctgggtgaactgcaccacttgtatgccccactgtaccaggaggcttcccgaaacacaagcaccatagaccccacccagccccagctccttggcagtagcttctttgaaaaacatcacgtgtctgtgcgccttggctatggctgtctcctggtactgcgtgccctgagctctgctgtgcctgccaacctgcacctgctgctgcggcctgtggcattggcattgcctgatctgcggcaagtggcagagctgactctgctgggtgcagggatgagggatgccttccagatggctacccgcctatccaaattcttctctctagagcgtgagctggtgtctgggcccctgccctgccgcctgccactgctcaagcagatactggaagacacaatacggacactaaatgtgaccaaggaggaaccgaagtgccagaagcctcgcagcctagctgccattgaggaggctgccctactgcgctcaccactgtttagcattctcaatgggctccacctgcacaacctccgagggctgttgtgtgcgcttttccctagcgccagccaagtgctggcagaacctatgacttacaagctgatgaagccattggtggtggaggaactgcaacaggtaggtctggatcccagccctgacattttggggtccttggaacagttgagccaggccctgagccgggcctcaggcattctgctcctgggccctgcgggcagcggcaagaccacttgttggcacagcttatttaagatccagaatcggctggcagccatggaggacacctcaacccaaggctgccagcctgtggaaattacccacctgtaccccagtggcctcagcccccaggagttcctgggatggctagagggctcctgctggcatcatggcatctttcccaaggtacttcgtgcagccggtcagtgtaacaacatgggccaaaagaggcagacagaggaatcaatcgggatccagcactggataatatgtgatggagcctccaatggtgcttggctggactccatcacttgcctcctgagtgagcttccccagcttagtctccccagtggacagcagatagcacgacccccaggcacctttctcttgatggaggtggctgacacaacaggcatatcccccacagtggtaggctgttgtgccctagtctggtgtggtggagagcagacttggcagtgtatacttagtgccctgatggcatcccttccttatgagtaccgcctgcagcaccggacagtcgctgagctcaaccacatggctgaggttctggtgcctgcaacattgcgattcctcacctgccaaggtgtcagctctctgctgcaggtacacgggcagcaggctgtttgtgcaggtgtggcagaagttaccagcatggcacgcatcttgcatagtctgcttgacctccaccttcgcctaaaggaggagaaggcccctggcccagaggacctcagctatagtgatcctgtggcccaaagcttcaggtcttcaaaaagcagctttctaaaccggtcccaggttgacagtgacgatgtgccagataagtgcagggaacacttgctggctgtcagcagttttctttttgccttgatctggggctttggagcccaccttccctccaggttctggcccatctttgataccttcataagggattctattagtcgcctctccaactaccctgagccaccaccctcagccttggtgtttgatctacatgtaagccctgaagatggaacactggtccccttcactggccaatacctgagcagccacatcaaaggaactttgggcacctttcacccttctatccagactgaacggctcttgtatgtggtggacctgcttctgtcagggggacagccagtgttgctggctggagaggcagcaacagggaagtcagcctttgtggaggtgctggtagagccacatcacccttacatatacagccccatccaccctgccttcagttcctcccacctccgtctcctgctgagcagaggaatccagggccaaacacaagccagcccacagcctgggcatcaccaggattctaaaccctccctcctcttcttgctggaggacctgcacctagccacttctgacccagagaagagctgccagccagtgttggagactctgcgccaggccatggatggcactgtgtatgcccacagcaccttggaactgcagacgctgcagcctacagtcaacttccttgccactgtcacagtgccaggatactgtgagcgcccactgtgtccacgcctctttcgactcttcacagtcctggccctggaaagcatgacccaggccaccctgctggaaagacatgtgcctatcattcaggcttggcttgagcgtttcccttctgtggaacgggagcgtgctctggcacgaggtctggttagggcctcagtagaggcctgggaggctgtgtgcaattgcttcatgccttcacccctccacccacactaccacttctccctacactctgtgagccacctactgagcagcctgcagctgctgcccaacagaacaggctcccgaggttttgtggactatcccaaccaccaggagcacttgcgccgggtgtcaggcctgcgaggcacttgtctgaccgttatgatggccacacgcaatgtggtgcgtctttggttgcatgaggcacagagaaccttttgcgaccggctggacagccccagggaacgctcctactgtgccaagctgctcctagtagtagctcaaagtgtcttctgctgtgggccagggccccagcacctgggcaaggaccatcaggagagtgaggaggaggaggaggaggagagggtgcccgaagtagaatctgaaggggagttggcccagtgggaggacttcagcaacagcaatagtgaaacagaggaggaagaggaaccttatggccttcaggtcgccagagtctcaaactccagagatccaagtctaacaccatccataggaccagtaagcagggggatgaaggaaagcataagtcacaagataaggcaagagaaaggcacaagggcatccaactataggctccaggtaaggagatcattcaagacttggtggcagaagaaaccccagatggacctgatctcacccttgttgttaccagtgttactactacatccccaggaaaagccctcagacctggtcttcagtcaggagctgatactggggcctaactctgagacccccaacttgtacctggaacgacagtgggagaagctagaggagcagttggccacctcagctgctcaactgaagttgagcccccacctggcccggtgtcattccatggcccagcacgtggcccgcctggtccgggtgctggccaggccccggcagcatggcctgctgctctcgggggctctgggtactgggcgccacactgccatcactctggcttctagcatttgtcaggcccatttctttcatctaccatctgggtcagaggaggccattctccaatgtctacgagatgccagctggcatgctggcatgttaagccagccagtggctctgttggtacccagtggtgtggatctcactacacttcatcgcctcctggccctggcaacctcaggcagtttccctggccagtacacagaagcagatttggaccgcattggagaacacctccccagggagaaccttggtgtcaaacagaacatcaagaaggaaatggtgttgcagaggttccaccagcaagtgtgcagccaccttcacctgttcttcctgattggagataaacaggcccacaagcagctgccctccacccttttcctgaggctccttcaactggccactgccagcattgaccgctatgaaccctgggaccaagctgccctggccaaggtggcccagcatcacctggagggtgctcagagtgtgccccttgatgacggctcctggaagtacccagacctccaggcctcaattcccagtgtggccaaagccatggctcttatccacctttcggccacccactaccatgagcacctgtgccctgcattgccactcgtcacccccaagaccttcctagacttcctggacactttcctgatgctgcagcaacagacaatcctgaagattaagaacaaggcccagcgggtccagaatgccttggagaatctgagaatgctgattaaggagcacggtacccatgccaatctgatctttgacttggaacagcagctgaaagactccggcaagagtctcagcatgtttcagcagcagctagagcaaagcaagctcctatacaagcagcagctggaagagtgtcggcatcaagagaacctcattgagaacctggccaggcaacgggatgccctgcaagctcagcgagaggctttcctggagcagatgagcaaggcatttctggagcctctgagccagctgcaggtggctgactttgaggagatacggagctatcgagcaccaccagaatctgtggtccgggtaactgatgcaatgtgtgacttgttccaccatgaaacaggctgggccagtgccaaacagctgttatgcactgaggatttttatcaggagctggtgttcttccccaaggagaagataacagactcagagctgataaagttacatctaattctgaaggctccaggtatggacgatgcagccctgcgggcagtgagccgacctgcagccagcctggcagcctggctctgggctgttctgcactatgggctggcgcattgccggggactgcccacggacctgctgctgcagcaagtggaggcaacactcactcgggagcaggcccgcctgggctactaccagtttcaggcccaggagaccctggagcataatttggccctggctaagatggtggaggatgcccaagcttcccacaactgcgtggcaaagaccctcagtcaagcacagtgtgggcagtatcacaaatggcccatgaaggctgcactgctcacgcctatgcgtgcctggactacacagctccagaagctgaagggacgctgcatgactgtgtttggagataccctcctatgttcagctgccatcatctacctgggtcccttcccaccattgcggcgccaagagctactggacgagtggttagctctgtgtaggggctttcaggaggctctgggcccagatgatgtggcacaggcactgaagcggaagcaaaaatctgtcagcataccaccaaagaaccccctgctggctacacactctcccttcagtattctgtccttgctgagctctgaatcggagcagtaccagtgggatggaaacctgaagccacaggcaaagtcggcccacctggcaggcttgcttctgcgaagccccacacactacagtagttgccgttggcctctgctgcttgaccccagcaacgaggccctcatctggttggacccgctgcctctggaagagaatcgatcttttgcgccagccctcactgagggtagagggaaaggcctcatgagaaatcaaaagagagagagtaaaacggacatgaaagaggaagatgatgagagtgaagagagtaatgaggctgaggaccagacaaaagagcagaaggcagaggaaagaaaaaatgagcaggagaaagagcaagaggaaaatgaagagaaagaggaggagaagacagagagccaggggtcaaagccagcctatgagactcagcttccatcccttccctaccttagtgttctttcaggtgctgacccagagctgggttctcagctccaggaggcagctgcttgtggcctgcctgtgttactgaccaatgtggagctgggtctagggtgcgaagaactgcaatggctgctgcaacgggagcagctgagtccaccccaggtgcagcctggcttctgtctgtatctcagcaccaccctctccctctgtgccatggaaaaagtgctaggttgtgaactgctaaaggggctgaatgtgttggatctgggcctgaacatggaaatactggaagaacagatgctgcatgaaatcttgtgcagagagtatcctgaactcgagacccgctggcaggacctaaagatcagagccctagatacctgcaaggctgtggaggctgctgaggagcggctgctgacgatgctgctgttccagaatccgaagcgtcagaagccagccaagtttctgcggaacatagtgagggcccaaggaaagctatgccagctgcgtgctcattgtgaagagttagaagggcagaaactacaggagatggtattgtgggcaccctatcgacctgtggtttggcatggaatggccatggtaaaggccctaagccaactgcagaacctgctgccacttttctgtatgagcccagagaactggctggcagtcactaagcaggctctggacagcatgaagccacgtgagattaatcacggggaggacctggccagccatctactgcaattgagagcacacctgacccgccagctgctgggcagcaccgtgactgcactgggccttacccaagtacccttggtgggtgcattgggcgctttggctctgctgcaagcaacagggaaagcatcagagctggaaagactggcactctggcctggactagcagcctctcccagcacagtccacagcaagccagtctcagatgtggctcgaccggcctggcttgggccaaaagcctggcatgaatgtgagatgttagagctgctgcccccatttgttggcctgtgtgcctccctggcaggccactccagtgcttggcaggcttacctgtcactgtcatccacagtgctgggtcctgcacctgggccagggcctgagccactcagcctcctccagaagctgatcctgtggcgcgttctgcgacctgagtgcctggcaggtgccctggcagacttcaccactagcctcctgggtcggcccctggatgaaaacacgtatgctcccaccatgccctttaaacatagtcaggctactcagcccatgctgatcttgttgccaccgcctggccacccctcagccactctgcatcctctgactgtcatccagaaactggctgccaagtatcagcaggggcagaagcaactgcaggtgatagccctgggctctgaagcctgggacccagtctcagttgtggtcagcactctatcccaggctatgtatgaggggcactggctggtgctggacaactgtcatctgatgccccattggccgaaagagctgctacagctcttgctggaactgttaggcagagccaaggtggttgcagacctggaatcagaacagcttttagaccaacctgaaagcaggaatgtaagcactgttcacagagattttcgtctttggcttattgtgcctgcagagtctagtgcttctttgccagctgtgctgactcagcactccatgcctgttttctggaaccagtccctggagctgggccatgttttgattgacagtgtggagctagcccagcaagtactctacatgcaaccccccacccaggcactacctctgctcctcctccatggcctcctgctacaccggcagctctatggaacaaggctgcaggcacacagggggcgctggagtcaagtgactctaacccaggttcttcagacccaagaccagctgtgggcaagtcttagcaatccccgtgctgccatgcaagagctggctgcttcagttttctacgggggtcctctgggggacactgaggacagggaggccctgattagcctcacacaagcctgcctgagccccagtagtgggagctgggtccagccacacacacctcagtctttgctggccacgctcatgcccctcccagagctaagggagctggatgcaatggcagagtgcaaggcccagatgcacctactgccctcaccacctgaaccccggctctgcggactgagtgagggcccccaagcctggctgttgcgacgccagagtcgcgctctcttgagtgcgctgcagcggagttcacccgtgtgggttcctgagtctcgaagaggcgcccagcttgcggaaaggcgactgcggcaacgcctagtgcaagtcaaccggaggctggagtcactgcaggatctgctgacccacgtgattcgccaagacgagtccgacgccccgtggtcagtgctggggccaaatgcacggcggcctctggagggcgtcttagagaccgaggctctagaactgagccagttggtgggcacgctacaacgcgaccttgattgcctgttgcagcagctgaagggcgcacccccgtgcccctcccgccgctgtgctgcggtggcccacgctctctggactggccgcctacccttgccttggcgacctcatgcgccggccggtccgcagccgccctggcactggctgcgacagttgtcgcgccgtgggcaactgttggttcgttacttgggcgtgggcgcggacgcgagcagtgatgtaccagagcgcgtcttccacctgtcagcctttcgccacccgcgccgcctgctgctggcattgcgtggggaagctgccctggaccagaatgtgcccagctcgaatttccctggtagccgaggctcggtctccagtcagctccagtataaacgtctggagatgaacagcaaccctctgcacttcagggtggagaatggtccaaatcccacggttccagagagagggctgctgctgatcgggctacaggtcctacatgcggagtgggacccaatagctggagccttgcaggacagtccttccagccaacccagccctctgcctcccgtcagcatcagcacacaggccccgggcaccagtgacctgccagccccagccgacctgactgtgtactcgtgtcctgtgtacatgggagggccccttggcaccgctaagctgcagagcaggaacatcgtgatgcatctgcctttacccaccaagctcacccccaacacctgtgtccaaaggagggtccatgtgtgcagcccacccctgtcttgagcccgtctaccaaaataaagttgtagtgattccatg

SEQ ID NO: 4076 - DNA, 899 bp, Homo sapiens
gaagcgcgtgaggaccggacgggcggcgccgtggggccttcccagggctctaggccgcctttagggtgggggaggggccgggcgaggggacgaccgccagcctcgggatttggggcttgggtcgtttctcacaagcaaccggaggcctgcgccgctgccggcgtctcccgggtgggagctcagcgcggaggctggggtctcggccggggacgtgtggggtgtgcccggaccctcccctccgcatcccgccccttaagcagctttaaggggccggagccggcggctatttctatcccaggaaatccccgggccatctgtgaccaacaaaggcccgagcccccccacccccgcgagcccaacaacagggcccaacggcccctggctccggggtggggggatcgggcctggatcggctgccggtgcctgccagtgggcagggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgcacgcctgctgctccaaggactgccccctggcaccacgccccagcgcttggagcagcatgtccaggccttgctgcgggcctcggggctcccagtacagccttgctgtgccttggccagccc

SEQ ID NO: 4077 - DNA, 1264 bp, Homo sapiens
ccggcggagcgtcctcgcatggagcgcgagcccagcgcctcggaggccgcccccgcggcggccgcgctcttcgcctggggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacaggtctcttgtggctcagagcataatttggcaataattggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtgatagagaatctttaataaagtggcttttcccaccaaa

SEQ ID NO: 4078 - DNA, 560 bp, Homo sapiens
aaactgtcatggcgctggtggcagtgtagcagtgaggacaaccagaggtcactctcatcaccatcttagttttgggtcttgctctgtcacccaggctggagtgccatggcatcatcatagctcactatggccttgatcctcctgccttagcctcccaagcagctggtattacagaccacggtgtgaacacatgaacagaagacgaaaatttcttctagcctcagtacttgctctccagaattcaagttttatatatccatcatgtcagaagtgcttctctaggataatcctggtctccaaaaggtctaattgtccaaaatgtggctctactggtgaatctggaaatgccaattacagatacaaactttccttaaaagttgcagaatcaaacaaattgtttgttattactgtatttggaagttgcttagatacattttttggtcttactgccactggtttgcacaggtacattcaggatcctaataaaattccagaaacactggacaatgatacaactcagaatctattaactaaagcagttgaaacttgctttgttggac

SEQ ID NO: 4079 - DNA, 818 bp, Homo sapiens
ctggctgagtgagatggcagctggcttggcaaggggacagcacctttgtcaccacattatgtccctgtaccctacatgctgcgcctatacccaggaccgatggtaactgaggcggaggggaaaggagggcctgagatggcaagtctgtcctcctcggtggttcctgtgtccttcatttccactctgcgagagtctgtgctggaccctggagttggtggagaaggagccagtgacaagcagaggagcaaactgtctttatcacactccatgatcccagctgctaaaatccacactgagctctgcttaccagccttcttctctcctgctggaacccagaggaggttccagcagcctcagcaccacctgacactgtctatcatccacactgcagcaaggtgattctgccaaaacatatctccttaaaagccaactggagcttctcatcagcatcaatgtgaagccaaaaatccttaggaggacagagggagtccctcacaacctagactggtccccttccctccagctgcctcaactgtccacaggactctcttcccacctgcggccacactgtgcaacctggaatttccccacctgggcggactcatcacgtcatcaccaattggatgcatcttctgctctgtgcagctggtgaaatctttctcaacccttgagatgcagcccaatcttctcctaacatctggattcctctctgtcactgcattccctcctgtcatcctgcctttgttttcttgccctcctttctctcccgggtgataggcattaactaaaattaaataaaaattcagatcatccttgca

SEQ ID NO: 4080 - DNA, 2351 bp, Homo sapiens
gggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagtgtgtgtttactgtcacaaaggcacattttcagacccctactcctgtggtgacggacaccctgagggtccccatggcaggactggccttttcccatcaactctcaagctctcgcctttcctatcagcctgctgccctgggcgttggatcagctgacctggcttatccagtagtgtttgctgctggcttaaatgctacacaccctcaccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtt

SEQ ID NO: 4081 - DNA, 4404 bp, Homo sapiens
acacacacacacacacacacacacacacacacctgagatggggtagatcattgtatttttgtgtctaccagcaagaaaaggaaggaaaaactaagggctctgtgtatgaatgacaaggataccttcagccagctcattctggatgaatgaatgattacactaagtgtcctccacattcctctgtgggctcacttcatggactcactttgcgtgcttgttaaatgtgctgtgttgctcccaagaccatgtaaagcctactgaccactaacctccctcacagcagaaactagacgtcaggttaaaatgggcaactccgacagtcagtacacccttcaaggatctaaaaatcatagcaatactattactggtgctaagcaaattccttgctccctgaaaatacgtggcattcatgcaaaagaggaaaagtcattgcatggatggggtcacggaagcaacggagcaggttacaagtccaggtccctggcccgaagctgcctttctcactttaagagtaaccagccttacgcatcgagactcggtggccccacatgcaaggtctccagaggtgttgcctactccacgcacaggacaaatgccccagggaaggatttccagggcatcagtgctgctttctcaactgagaatggcttccactctgttggccacgagctggcagataaccacatcacctccagagactgcaacggacaccttctcaactgctacgggaggaatgagagcattgcctccaccccaccgggcgaagaccgcaagagcccccgagtgctcatcaaaacgctggggaagctggatgggtgtttaagggtcgagttccacaatggtggcaaccccagcaaagtgcctgcagaggactgcagtgagccggtgcagctgctgaggtactcacctaccttagcatcggaaacctcccctgtgcctgaagccaggagggggtccagcgccgattccctgcccagccatcgcccctctcccacggactctcgcctgcggtccagcaaaggcagctccctgagttctgagtcatcctggtacgactccccttggggcaatgctggagagctgagcgaggctgagggctccttcctggcccccggcatgcctgaccccagtctccatgccagcttcccacctggcgatgccaaaaagcctttcaaccaaagctcttccctctcctccctccgggaactgtacaaagatgccaacctggggagcctctccccctcaggtatccgcctttctgatgaatacatgggcacgcatgccagcctgagcaaccgtgtctcttttgcttccgacattgatgtgccctccagagtggcacacggggaccccatccagtacagttccttcactctcccctgtcggaagcccaaagcctttgttgaggatactgcgaagaaggactccctcaaagccaggatgcgacggatcagtgactggacgggaagcctctcaaggaagaaaaggaaactccaggagccgaggtccaaggagggcagtgactactttgacagtcgctctgatggactgaatacagatgtgcagggatcctcccaggcatctgcttttctgtggtcagggggctctactcagatcctgtctcagagaagtgaatccacacatgcgattggcagcgatcccctccggcagaacatttatgagaatttcatgcgagagttggaaatgagcaggaccaacactgagaacatagaaacatctacagaaaccgccgagtccagcagcgagtcactcagctctctggaacagctggatctgctctttgagaaggaacagggggtggtccggaaggccgggtggctcttcttcaagcccctggtcactgtgcagaaggaaaggaagcttgagctggtggcacgaaggaaatggaaacagtactgggtaacgctgaaaggatgcacgctgctgttttatgagacctatgggaagaattccatggatcagagcagtgcccctcggtgtgctctgtttgcagaagacagcatagtgcagtctgttccagagcatcccaagaaagaaaatgtgttctgcctcagcaactcctttggagatgtctaccttttccaggccaccagccagacagatctagaaaactgggtcactgctgtacactctgcttgtgcatccctttttgcaaagaagcatgggaaagaggacacgctgcggctgctgaagaaccagaccaaaaacctgcttcagaagatagacatggacagcaagatgaagaagatggcagagctgcagctgtccgtggtgagcgacccaaagaacaggaaagccatagagaaccagatccagcaatgggagcagaatcttgagaaatttcacatggatctgttcaggatgcgctgctatctggccagcctacaaggtggggagttaccgaacccaaagagtctccttgcagccgccagccgcccctccaagctggccctcggcaggctgggcatcttgtctgtttcctctttccatgctctggtatgttctagagatgactctgctctccggaaaaggacactgtcactgacccagcgagggagaaacaagaagggaatattttcttcgttaaaagggctggacacactggccagaaaaggcaaggagaagagaccttctataactcaggtcgatgaacttctgcatatatatggttcaacagtagacggtgttccccgagacaatgcatgggaaatccagacttatgtccactttcaggacaatcacggagttactgtagggatcaagccagagcacagagtagaagatattttgactttggcatgcaagatgaggcagttggaacccagccattatggcctacagcttcgaaaattagtagatgacaatgttgagtattgcatccctgcaccatatgaatatatgcaacaacaggtttatgatgaaatagaagtctttccactaaatgtttatgacgtgcagctcacgaagactgggagtgtgtgtgactttgggtttgcagttacagcgcaggtggatgagcgtcagcatctcagccggatatttataagcgacgttcttcccgatggcctggcgtatggggaagggctgagaaagggcaatgagatcatgaccttaaatggggaagctgtgtctgatcttgaccttaagcagatggaggccctgttttctgagaagagcgtcggactcactctgattgcccggcctccggacacaaaagcaaccctgtgtacatcctggtcagacagtgacctgttctccagggaccagaagagtctgctgccccctcctaaccagtcccaactgctggaggaattcctggataactttaaaaagaatacagccaatgatttcagcaacgtccctgatatcacaacaggtctgaaaaggagtcagacagatggcactctggatcaggtttcccacagggagaaaatggagcagacattcaggagtgctgagcagatcactgcactgtgcaggagttttaacgacagtcaggccaacggcatggaaggaccgcgggagaatcaggatcctcctccgaggtctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacggaagcactaaaggcaatggagaaagtagcgagccacatcaatgagatgcagaagatctatgaggattatgggaccgtgtttgaccagctagtagctgagcagagcggaacagagaaggaggtaacagaactttcgatgggagagcttctgatgcactctacggtttcctggttgaatccatttctgtctctaggaaaagctagaaaggaccttgagctcacagtatttgtttttaagagagccgtcatactggtttataaagaaaactgc

SEQ ID NO: 4082 - DNA, 581 bp, Homo sapiens
actagctaggccgtgtggccaccctttggcacccgcaccggctcagacctgctcaggactcagccagggcacacagtttgtgttcttacgtgcatccatctgtctgtctgtgtgcgtctctgtggaggactgaggttttcaagtgaaagagagtgaagacatagtccagagagggaagtgtaaagctacaggctgaacataacttctttttttcaaagttccctgtgttgtgaactgagcttgggtgaagtgaaatctttgaggaagctaaagctgtgtgtatttgtggatcagacaagtgcagcaagttaatatcattggcttctgaaggggagagtgaggtgatggctgcgtttaagttggatttccttccagaaatgatggtggatcattgctctttgaattccagtcccgttatgtttcagcagaaatcaaggtagacgaagtaacctcttgtcctgaattttcatagttgctcattcttaataatggcagcagaagcaacaatgagagtaactacctcctcagctcaaagaaaatgaacggcaccctggaccacccagaccaaccagatcttgatg

SEQ ID NO: 4083 - DNA, 685 bp, Homo sapiens
gggggcgggggcggcaggccgcgcggcgcagcgggtcagaggcgctcctgggctcgggccggggactcaccggtggccgggcgccgcaggccgggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgcacgcctgctgctccaaggactgccccctggcaccacgccccagcgcttggagcagcatgtccaggccttgctgcgggcctcggggctcccagtacagccttgctgtgccttggccagcccccggccagaccgggctctggtccagttgcccaagcccctttctgaggcagatgtccgtgtcctggaggagcaggcccagaatctgggcctggaggggaccttggtgtccctggcccgggttccccaggcc

SEQ ID NO: 4084 - DNA, 538 bp, Homo sapiens
acgtccgccattttgggcgcttcgctgatggtgtcggtgagcgcgtttcccgcctgagcgcaactagcggcgggtcgtgggcacctccagataagaaaacaagctcagagagatgtggtgacttgctcaaatagtgacagaacttcctcggccatatggaggggtcatataatacccttgtgtcttcagtttgaggtacctcccataattttaaggggctcagaaggaaagaaaacatctcccaggaccagatgtggagtagatgggagttggagagaagctgaagcccaggcccagcaacaggctgggggcccaggtgcttcgggggtcccagccattaacagagcttcgtgcaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcact

SEQ ID NO: 4085 - DNA, 589 bp, Homo sapiens
gcgcaactccacctgcttctgggaacccagggggaagcaagggaagaccgtgacctttgccccgggctgtggggagccccggagcctgggcccggagaagcgccagggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgcacgcctgctgctccaaggactgccccctggcaccacgccccagcgcttggagcagcatgtccaggccttgctgcgggcctcggggctcccagtacagccttgctgtgccttggccagcccccggccagaccgggctctggt

SEQ ID NO: 4086 - DNA, 5844 bp, Homo sapiens
gggcggcctatagatccaagagaaggtcctggacggcctccactagatggtagggatcattttggaagacctcctgtagatataagagagaatcttgtgaggccaggtatagatcatcttggtcgaagagaccactttggctttaatccagagaagccctgggggcatagaggagattttgatgagagagagcatcgggttctaccggtctatggtggtccaaaaggcttacatgaagaaagaggtagatttcggtctggaaactatcgatttgatcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacaccactaacctccctcacagcagaaactagacgtcaggttaaaatgggcaactccgacagtcagtacacccttcaaggatctaaaaatcatagcaatactattactggtgctaagcaaattccttgctccctgaaaatacgtggcattcatgcaaaagaggaaaagtcattgcatggatggggtcacggaagcaacggagcaggttacaagtccaggtccctggcccgaagctgcctttctcactttaagagtaaccagccttacgcatcgagactcggtggccccacatgcaaggtctccagaggtgttgcctactccacgcacaggacaaatgccccagggaaggatttccagggcatcagtgctgctttctcaactgagaatggcttccactctgttggccacgagctggcagataaccacatcacctccagagactgcaacggacaccttctcaactgctacgggaggaatgagagcattgcctccaccccaccgggcgaagaccgcaagagcccccgagtgctcatcaaaacgctggggaagctggatgggtgtttaagggtcgagttccacaatggtggcaaccccagcaaagtgcctgcagaggactgcagtgagccggtgcagctgctgaggtactcacctaccttagcatcggaaacctcccctgtgcctgaagccaggagggggtccagcgccgattccctgcccagccatcgcccctctcccacggactctcgcctgcggtccagcaaaggcagctccctgagttctgagtcatcctggtacgactccccttggggcaatgctggagagctgagcgaggctgagggctccttcctggcccccggcatgcctgaccccagtctccatgccagcttcccacctggcgatgccaaaaagcctttcaaccaaagctcttccctctcctccctccgggaactgtacaaagatgccaacctggggagcctctccccctcaggtatccgcctttctgatgaatacatgggcacgcatgccagcctgagcaaccgtgtctcttttgcttccgacattgatgtgccctccagagtggcacacggggaccccatccagtacagttccttcactctcccctgtcggaagcccaaagcctttgttgaggatactgcgaagaaggactccctcaaagccaggatgcgacggatcagtgactggacgggaagcctctcaaggaagaaaaggaaactccaggagccgaggtccaaggagggcagtgactactttgacagtcgctctgatggactgaatacagatgtgcagggatcctcccaggcatctgcttttctgtggtcagggggctctactcagatcctgtctcagagaagtgaatccacacatgcgattggcagcgatcccctccggcagaacatttatgagaatttcatgcgagagttggaaatgagcaggaccaacactgagaacatagaaacatctacagaaaccgccgagtccagcagcgagtcactcagctctctggaacagctggatctgctctttgagaaggaacagggggtggtccggaaggccgggtggctcttcttcaagcccctggtcactgtgcagaaggaaaggaagcttgagctggtggcacgaaggaaatggaaacagtactgggtaacgctgaaaggatgcacgctgctgttttatgagacctatgggaagaattccatggatcagagcagtgcccctcggtgtgctctgtttgcagaagacagcatagtgcagtctgttccagagcatcccaagaaagaaaatgtgttctgcctcagcaactcctttggagatgtctaccttttccaggccaccagccagacagatctagaaaactgggtcactgctgtacactctgcttgtgcatccctttttgcaaagaagcatgggaaagaggacacgctgcggctgctgaagaaccagaccaaaaacctgcttcagaagatagacatggacagcaagatgaagaagatggcagagctgcagctgtccgtggtgagcgacccaaagaacaggaaagccatagagaaccagatccagcaatgggagcagaatcttgagaaatttcacatggatctgttcaggatgcgctgctatctggccagcctacaaggtggggagttaccgaacccaaagagtctccttgcagccgccagccgcccctccaagctggccctcggcaggctgggcatcttgtctgtttcctctttccatgctctggtatgttctagagatgactctgctctccggaaaaggacactgtcactgacccagcgagggagaaacaagaagggaatattttcttcgttaaaagggctggacacactggccagaaaaggcaaggagaagagaccttctataactcaggtcgatgaacttctgcatatatatggttcaacagtagacggtgttccccgagacaatgcatgggaaatccagacttatgtccactttcaggacaatcacggagttactgtagggatcaagccagagcacagagtagaagatattttgactttggcatgcaagatgaggcagttggaacccagccattatggcctacagcttcgaaaattagtagatgacaatgttgagtattgcatccctgcaccatatgaatatatgcaacaacaggtttatgatgaaatagaagtctttccactaaatgtttatgacgtgcagctcacgaagactgggagtgtgtgtgactttgggtttgcagttacagcgcaggtggatgagcgtcagcatctcagccggatatttataagcgacgttcttcccgatggcctggcgtatggggaagggctgagaaagggcaatgagatcatgaccttaaatggggaagctgtgtctgatcttgaccttaagcagatggaggccctgttttctgagaagagcgtcggactcactctgattgcccggcctccggacacaaaagcaaccctgtgtacatcctggtcagacagtgacctgttctccagggaccagaagagtctgctgccccctcctaaccagtcccaactgctggaggaattcctggataactttaaaaagaatacagccaatgatttcagcaacgtccctgatatcacaacaggtctgaaaaggagtcagacagatggcactctggatcaggtttcccacagggagaaaatggagcagacattcaggagtgctgagcagatcactgcactgtgcaggagttttaacgacagtcaggccaacggcatggaaggaccgcgggagaatcaggatcctcctccgaggtctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacggaagcactaaaggcaatggagaaagtagcgagccacatcaatgagatgcagaagatctatgaggattatgggaccgtgtttgaccagctagtagctgagcagagcggaacagagaaggaggtaacagaactttcgatgggagagcttctgatgcactctacggtttcctggttgaatccatttctgtctctaggaaaagctagaaaggaccttgagctcacagtatttgtttttaagagagccgtcatactggtttataaagaaaactgcaaactgaaaaagaaattgccctcgaattcccggcctgcacacaactctactgacttggacccatttaaattccgctggttgatccccatctccgcgcttcaagtcagactggggaatccagcagggacagaaaataattccatatgggaactgatccatacgaagtcagaaatagaaggacggccagaaaccatctttcagttgtgttgcagtgacagtgaaagcaaaaccaacattgttaaggtgattcgttctattctgagggagaacttcaggcgtcacataaagtgtgaattaccactggagaaaacgtgtaaggatcgcctggtacctcttaagaaccgagttcctgtttcggccaaattagcttcatccaggtctttaaaagtcctgaagaattcctccagcaacgagtggaccggtgagactggcaagggaaccttgctggactctgacgagggcagcttgagcagcggcacccagagcagcggctgccccacggctgagggcaggcaggactccaagagcacttctcccgggaaatacccacaccccggcttggcagattttgccgacaatctcatcaaagagagtgacatcctgagcgatgaagatgatgaccaccgtcagactgtgaagcagggcagccctactaaagacatcgaaattcagttccagagactgaggatttccgaggacccagacgttcaccccgaggctgagcagcagcctggcccggagtcgggtgagggtcagaaaggaggagagcagcccaaactggtccgggggcacttctgccccattaaacgaaaagccaacagcaccaagagggacagaggaactttgctcaaggcgcagatccgtcaccagtcccttgacagtcagtctgaaaatgccaccatcgacctaaattctgttctagagcgagaattcagtgtccagagtttaacatctgttgtcagtgaggagtgtttttatgaaacagagagccacggaaaatcatag

SEQ ID NO: 4087 - DNA, 547 bp, Homo sapiens
agtgaagcctgcccacttgtgaagacggagactccccgctccccggatgagaagcaagtgcgtcagagggaagcagcccaactggttgctgagttgtggaaaataagctgggggagaaaaaacacttcttttaaaaatcaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggact

SEQ ID NO: 4088 - DNA, 549 bp, Homo sapiens
gaaattcagaacaggaggacacaagggcaggggaatgctgaggccaaggccttctcccaccacctgcctcctgcgggagtgattccacagtgcagagggagagccatttggaggtccggcacccgctctgcccatgcctatgcttcaggctctgtgagaaggctggactccttctggaacttcaggaccttggatgctcccctcctctgctcctgcctcccttcccccagccctggggtgtgtcagatgtgtgttttctcctggactcagctgaagcaaggtcagcccagctttcaaggggaggagcttccacactctaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaagg

SEQ ID NO: 4089 - DNA, 2603 bp, Homo sapiens
agattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagc

SEQ ID NO: 4090 - DNA, 717 bp, Homo sapiens
ttttttttttttttttttgccccttcttttcttgttagactggtttgaacaccccagcatctgtcctgtatttgtcaggtgaaaccagaagtctttggataatgaaacccgtgaccaattcttacccaaggtggttatgacatatgtcagctgcttcttggcctatatagttagaagccgacctcttttaccttgtgaataattatgtcatcacctccattattcttttggtgttctcaattgaaatgccaagcattaaatgagccacaaagattgaattcccattatccttgaatcagagcaagcctgtcgtgcagccatgagttagtggagaaaaatccggagttagagaagattataaatggcagagccatttaactgtggttagctgttggattctgatactttcttaaaaatacgttcttgcaccaacatcttcattgggaacagttcagaaaaagcaaagaggagagccaacattcacatttaccatggctataccaataacagtgcttgactgtgacctcttgctatatggccgtggtcaccggacattggaccgttttaagctggatgatgtgactgatgaatacttgatgtccatgtatgggtttccacggcagttcatttattacttggtggagctcttgggggcgaatctttctaggcctactcagcgatccagggctattagcccagagacacaggtccttgcag

SEQ ID NO: 4091 - DNA, 2909 bp, Homo sapiens
ctctccccggccgtggcccccgcggcttagacgcctcctccgccgccgccgctcggagcaacccgggggccggatggacggggccgcggggcccggtgacggccctgctcgggaggccctccagtctctgagccagcggcttcgggtgcaggagcaggagatggaactggtaaaggcagccctggcagaagcccttcgcctgctgcggctgcaggtgcccccttcctccctgcagggctctggcacaccagctcctccgggggacagtcttgcagcccccccaggactgccacccacgtgcaccccttccttggtgagccgaggcacccagacggagacagaggtggagctcaagtcatcccctggaccccctggcctgagcaatggacccccagcccctcagggggccagcgaagagcctagcgggacccaatctgaaggagggggcagcagcagcagtggtgctggctcccctggccccccggggatcctcaggcccttgcagcccccacagcgtgctgacacgccgcgaagaaattcttcctcctcctcatccccctcagagcggcctcggcagaagctctccaggaaggcaatctcctccgccaacctgttagtgcggtccgggagcacagagagccgtgggggaaaagaccccctctccagccctgggggccctggatctcggaggagcaattacaatttggaaggcatctcagtgaagatgttccttcgagggcgccccattaccatgtacatcccgtctggcatccgcagccttgaggagctgccgagtggcccaccgccagagaccctcagccttgactgggtttatgggtacaggggtcgtgactcccgctctaatctgtttgtgttgcgctctggggaggtggtctactttatcgcctgtgtggtggtgctgtaccggcctggaggaggcccagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggatgattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacgtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtc

SEQ ID NO: 4092 - DNA, 529 bp, Homo sapiens
agtctgcttgtggtgtgagtggtgcctgtggcaggccctctgcagccagggtcggcgtaatggataacctgtgatgagttccattagagaaaacgtggaaaaagcagggatggatttacccttgtagaagcagggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgcacgcctgctgctccaaggactgccccctggcaccacgccccagcgcttggagca

SEQ ID NO: 4093 - DNA, 603 bp, Homo sapiens
ttttgggcgcttcgctgatggtgtcggtgagcgcgtttcccgcctgagcgcaactagcggcgggtcgtgggcacctccaggctcagaaggaaagaaaacatctcccaggaccagatgtggagtagatgggagttggagagaagctgaagcccaggcccagcaacaggctgggggcccaggtgcttcgggggtcccagccattaacagagcttcgtgcaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaa

SEQ ID NO: 4094 - DNA, 1375 bp, Homo sapiens
gtcacgtgttgttgttgggccgggaaagctgcttccgggtcaatgcaggacactgggctccggcggccagagtgggggactagcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgaggtcagtaaaattgtgtcaaatgttcctcagttggagtttctaaacctgagttccaaccctctgaatttgtcggttttagaaagaacatgtgctgggtccttctctggggttcgcaaacttgtcctcaacaacagcaaagcttcttgggagacggtccacatgatactacaggagttaccagatttggaggagctcttcctgtgccttaatgactatgaaacagtgtcttgtccttctatttgctgtcattctcttaagctactacatataacagacaataacctccaagactggactgaaatacgaaagttaggagttatgtttccttcactggataccctcgtcctggccaacaatcatttgaatgctattgaggagcctgatgattcattggccaggttgtttcctaatcttcgatccatcagcctccacaagtcaggtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcagtgcaaaagtagaagtccactttaacgatcaggtggaagaaatgagcattcgtctggaccaaacagtggcagaactaaagaaacagttaaaaactctagtacaattacccacaagcaacatgcttctctactattttgaccatgaagcaccctttggcccagaggaaatgaagtacagctctcgggcattgcattcctttggcattagggatggagataaaatttacgtggaatccaaaacaaaataa

SEQ ID NO: 4095 - DNA, 551 bp, Homo sapiens
gagaaattgggcctggcattttgagtgacttctgagattatctgaatctcacactttgctgacctctttttggagggcattgcctgtggcctggcccagagaggatgggcaggtgttttctgagtcacacagcagaccaagtgtggagacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagc

SEQ ID NO: 4096 - DNA, 3228 bp, Homo sapiens
gtctggctcgggaggcgttcctggggccaaggccatggccccgcggctgcagctggagaaggcggcctggcgctgggcggagacggtgcggcccgaggaggtgtcgcaggagcacatcgagaccgcttaccgcatctggctggagccctgcattcgcggcgtgtgcagacgaaactgcaaaggaaatccgaattgcttggttggtattggtgagcatatttggttaggagaaatagatgaaaatagttttcataacatcgatgatcccaactgtgagaggagaaaaaagaactcatttgtgggcctgactaaccttggagccacttgttatgtcaacacatttcttcaagtgtggtttctcaacttggagcttcggcaggcactctacttatgtccaagcacttgtagtgactacatgctgggagacggcatccaagaagaaaaagattatgagcctcaaacaatttgtgagcatctccagtacttgtttgccttgttgcaaaacagtaataggcgatacattgatccatcaggatttgttaaagccttgggcctggacactggacaacagcaggatgctcaagaattttcaaagctctttatgtctctattggaagatactttgtctaaacaaaagaatccagatgtgcgcaatattgttcaacagcagttctgtggagaatatgcctatgtaactgtttgcaaccagtgtggcagagagtctaagcttttgtcaaaattttatgagctggagttaaatatccaaggccacaaacagttaacagattgtatctcggaatttttgaaggaagaaaaattagaaggagacaatcgctatttttgcgagaactgtcaaagcaaacagaatgcaacaagaaagattcgacttcttagccttccttgcactctgaacttgcagctaatgcgttttgtctttgacaggcaaactggacataagaaaaagctgaatacctacattggcttctcagaaattttggatatggagccttatgtggaacataaaggtgggtcctacgtgtatgaactcagcgcagtcctcatacacagaggagtgagtgcttattctggccactacatcgcccacgtgaaagatccacagtctggtgaatggtataagtttaatgatgaagacatagaaaagatggaggggaagaaattacaactagggattgaggaagatctagaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtagatcgggataattccaaatttgaggagtggtgtattgaaatggctgagatgcgtaagcaaagtgtggataaaggaaaagcaaaacacgaagaggttaaggagctgtaccaaaggttacctgctggagctgagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcagcgatggattttgggtggggaagtcctccttgcggagttggcgccagctagctcttgaacagctggatgagcaagatggtgatgcagaacaaagcaacggaaagatgaacggtagcaccttaaataaagatgaatcaaaggaagaaagaaaagaagaggaggaattaaattttaatgaagatattctgtgtccacatgctgttttttttttttccaaatatatttttttaaactcaggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaagaaaatgaagccttacataagatgattgcaaacgagcaaaagacttctctcccaaatttgttccaggataaaaacagaccgtgtctcagtaactggccagaggatacggatgtcctctacatcgtgtctcagttctttgtagaagagtggcggaaatttgttagaaagcctacaagatgcagccctgtgtcatcagttgggaacagtgctcttttgtgtccccacgggggcctcatgtttacatttgcttccatgaccaaagaagattctaaacttatagctctcatatggcccagtgagtggcaaatgatacaaaagctctttgttgtggatcatgtaattaaaatcacgagaattgaagtgggagatgtaaacccttcagaaacacagtatatttctgagcccaaactctgtccagaatgcagagaaggcttattgtgtcagcagcagagggacctgcgtgaatacactcaagccaccatctatgtccataaagttgtggataataaaaaggtgatgaaggattcggctccggaactgaatgtgagtagttctgaaacagaggaggacaaggaagaagctaaaccagatggagaaaaagatccagattttaatcaaagcaatggtggaacaaagcggcaaaagatatcccatcaaaattatatagcctatcaaaagcaagttattcgccgaagtatgcgacatagaaaagttcgtggtgagaaagcacttctcgtttctgctaatcagacgttaaaagaattgaaaattcagatcatgcatgcattttcagttgctccttttgaccagaatttgtcaattgatggaaagattttaagtgatgactgtgccaccctaggcacccttggcgtcattcctgaatctgtcattttattgaaggctgatgaaccaattgcagattatgctgcaatggatgatgtcatgcaagtttgtatgccagaagaagggtttaaaggtactggtcttcttggacattaatctttgaatacttgctgactgctaagaaatgaccagaggggaagaggagt

SEQ ID NO: 4097 - DNA, 2566 bp, Homo sapiens
ccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagtggaacgacctgtggaaacctgtgatccattctcattaaataaatctctggattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggagtcgcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctct

SEQ ID NO: 4098 - DNA, 3228 bp, Homo sapiens
cgtgggcacctccagataagaaaacaagctcagagagatgtggtgacttgctcaaatagtgacagaacttcctcggccatatggaggggtcatataatacccttgtgtcttcagtttgaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactga

SEQ ID NO: 4099 - DNA, 1688 bp, Homo sapiens
gcgattttccttcggctgaggcaggagctttaggaccacttgctttcaggaaaagaaaatgagtaactctctcttcaggatggtgatggggcctggccagtccaaggaggctcctgggtggtcactgagtgggaggtcatcttcactgtttcctctcctccatggtaggaaatcactgaccaggacatgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgagg

SEQ ID NO: 4100 - DNA, 696 bp, Homo sapiens
attaccttgtcaccttctgaggttacttgtgacgatgccaatgatggtgtgagatggggaggtgcaggcaggacagaaagctgcaggaatgggcaggcaagacctgaggcgggaggaaggctgtgctgcaatgcacattcttggagaccaagggtggggaaccgcccatgctcagcacctggcagcagggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgcacgcctgctgctccaaggactgccccctggcaccacgccccagcgcttggagcagcatgtccaggccttgctgcgggcctcggggctcccagtacagccttgctgtgccttggccagcccccggccagaccgggctctggtccagttgcccaagcccctttctgag

SEQ ID NO: 4101 - DNA, 703 bp, Homo sapiens
gggaagggtcagaccaccatccgggtactctaaggtacataaaagagtcctccctcccccttctccttcacccccaagtgtctcccacgactgccctccccgacctctagctgaccatggcatcagaggcagaaaaaacattccatcggtttgctgcgtttggagaatcatcaagcagtggcactgaaatgaacaacaagaacttctccaagctgtgcaaagactgtggcatcatggatggcaagacagtcacctccacggacgtggacatcgtgttcagcaaagtcaaggccaagaacgcccgaaccatcacgtttcaacagttcaaagaggcagtgaaggaactgggccagaagcgcttcaaagggaagagtccagatgaagtcctggagaacatttatggactcatggagggcaaagacccagccaccactggcgctactaaagcaacaacagtgggtgcagtggaccgtttgacagacaccagcaagtacaccggcacccacaaggagcgctttgatgagagtggcaagggcaagggcattgcgggacgggaagagatgactgacaacacaggctatgtgagtggttacaagggttctggcacctacgataagaagaccaagtagagaggagcttcatctcagcctgctagccccctgaccctgcatgtttaacaccagggagcttggaaaacaataaa

SEQ ID NO: 4102 - DNA, 588 bp, Homo sapiens
cagtccccacttccctcctcactctcttgggagcgaggcctcttaccattgttctggcgtgaggaaaggcctgctgttgcctcaccaagcccactcgtgaacccgctgatgccgagcccgcctgcctgagtcttgatcgctgacttgagctcgtgattctcccgaatgagccgcaccaacttcttcagttcctcattttcccgcaccagcctctctatctgatgccgaagcccttcataattgcagggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgc

SEQ ID NO: 4103 - DNA, 2030 bp, Homo sapiens
gaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctg

SEQ ID NO: 4104 - DNA, 2469 bp, Homo sapiens
ggagagcgctggtggtagggaggcttctcccggttctgtgagcagcaggaccctcccgagggcctgaccgtggaggtagcactgcacacccactccctgtgggccggagccaggaggcacttcctgggtgtcggagcccagaaggaaaccagtggccgggaagcaccagctgggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgctgcggctgctggacatcgagtcacaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggcagagctggtgcacgaggacatcgagagcgcgttggccgactgccggctgggcaagaagatgcggccgcagaccctgaagggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcagagggcgtcctcacactgcgggcacggcccccctctgagggcgagttcatcgactgcttccagaaaatcaagctggcgattaacttgctggcaaagctgcagaagcacatccagaaccccagcgccgcggagctcgtgcacttcctcttcgggcctctggacctgatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttata

SEQ ID NO: 4105 - DNA, 549 bp, Homo sapiens
aagggtcctcaggggttcttccctggaagcgggaggtgcagtgctttacttccaactatgtggtcaattttgtttacaagagctcctgaaggaagcactaaacatggaaaggaacaaccggtaccagccactgcaaaaacatgccaaattgtaaagaccatcgatgttaggaagaaactgcctcaactaatgagcaaaataaccagctaacatcgtaatgacaggatcaaattcacacataacgatattaaccttaaaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcg

SEQ ID NO: 4106 - DNA, 1233 bp, Homo sapiens
ccgagaattcgtgggtgctcaagaggatgggtgtggcctggcagcgcaggcgcactagaggcctgtagggtcggggcgcctgcgcagtcgctcttcctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcactgcttctgtgaacagtctttgtctcctccccacctttggtgggaagtgcggggcagtcctggtcaagacactcatgccctggcaatgtggctgccagagaatgttgttgctaacccaccagtttcttgttgatttggagaggtcaaggccaggcccccacttggcttgaagggacattttcagacttttctttctgtcacttggagtgtctatgcctctcatatttccctaataaactcctcaactttttatctgactgctgtgattatggtggggagaggagctagagatgggttcacttattgcacagaaatgtaatacatggcgttattattctaacataaaactttcagatgtagctgtttgattcaaagcctaggtggcttaccagcccaagtccccatgtttggactttcagctgactagctcatcttgggaatcatttggtcattcagcacatttaccaagtatttactatgtaggcatgttaaactccaataaaacatacagcattgaatcaga

SEQ ID NO: 4107 - DNA, 637 bp, Homo sapiens
ccaccgaggtcgcacgcgtgagacttctccgccgcctccgccgcagacgccgccgcgtgagtgtggtgaccgggcccggggtgccggctggggacgcggagtccgtggggatgcggggtgggcggcggggtatttttgggacggaggcctacgggccgagccacgcgcggcctcgcccggcggccccgggatgggccggcaggaggccgccggggtaactccgccgtcgcgtcctctccgcccgcctcaggatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatc

SEQ ID NO: 4108 - DNA, 1362 bp, Homo sapiens
accacaaagcggttggttgcggcagggactacaccggtgtatcatgggagcggcccgggctacacgttaaaaacactaaggggagcgcgcgaagctgaacttggcgctcgatgggggccgttagccgccctagagcgcgcggagccgcagaggcgtagctggactacaacgcagtgcatctcgggaggccaactcgactggactggccccctcatgcccggctgcgagctgcccgtgggcacctgcccggacatgtgcccggccgccgagcgcgcccagcgcgaaagggagcaccgcctgcaccgcttggaggtggtgccgggttgccgccaggacccgccccgcgcggatccgcagcgcgcggtgaaggagtacagccgacccgccgccggcaagccccggcccccgcccagccagttgcgtccgccctccgtgctgctggccaccgtgcgctacctggccggtgaggtggcggagagcgccgacatcgcccgcgccgaggtggccagcttcgtggcagaccgcttgcgagctgtgctcctggacctggcgctgcagggagcgggcgacgccgaggcagctgtggtgctggaggcggcgctggccacgctgctgaccgtagtggcgcggctcgggcccgacgcggcgcggggacccgcggacccggtgctgctgcaggcccaggtgcaggagggcttcggctcgctgcggcgctgctacgcgcggggcgccgggccgcacccccgccaacccgccttccagggcctctttctgctctataacctgggctcggtggaagccctgcatgaggttctacagctgcctgctgccctgcgcgcctgcccgcccctccgcaaggccttggcggtagatgctgccttccgagagggcaatgctgcccgcctgttccgtctgctccagaccctgccctacctgccaagttgcgctgtgcagtgccatgtgggccatgcccgccgggaagccctggcccgcttcgctcgtgcctttagcacccccaagggccagaccttgcctctgggcttcatggtcaacctcttggccctggatggactcagggaagcacgggacctgtgccaggcccacgggctgcccttggacggagaggagagagttgtgttcctgaggggtcgctacgtggaggaagggctaccgcctgccagtacgtgcaaggtgttagtggagagcaaacttcgaggacgtaccctggaggaggtggtcatggcagaggaggaagatgagggcacggacagacctgggtccccagcctgaggagggagcgtgagcctcccagagccccaggactgggccagagcacttaggtttctttttccatggtttcca

SEQ ID NO: 4109 - DNA, 4415 bp, Homo sapiens
aaggtccctttaaggcgacggcgccttcctcgggtcagactaccggcggcgacgaccacaggagcatggcggacaccgacctgttcatggaatgtgaggaggaggagttggagccatggcagaaaatcagtgatgtcattgaggactctgtagttgaagattataattcagtggataaaactaccacagctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgagggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgac

SEQ ID NO: 4110 - DNA, 687 bp, Homo sapiens
agagctttgtgctgaacatcagtcctccacatcgactcctcttgtaagatgttgtgtccaggtggatcatcacagtggctgccatccttaaatatgtcttggtcctgttgctgctaattgataccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaa

SEQ ID NO: 4111 - DNA, 582 bp, Homo sapiens
gctctggggcttggtgggggcaatccctgcgtccggagagcgctggtggtagggaggcttctcccggttctgtgagcagcaggaccctcccgagggcctgaccgtggaggtagcactgcacacccactccctgtgggccggagccaggaggcacttcctgggtgtcggagcccagaaggaaaccagtggccgggaagcaccagctgggtcagtctccaggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcag

SEQ ID NO: 4112 - DNA, 2294 bp, Homo sapiens
tggcgcatatggtattctaaatattactggaagtaacagggatgctctgtagatccccaacaatacttttgagaagcagttgctgatatatttttccattcagtggaaacctatccgagcaaatttcatggttgcactgatctcttaacaatatgtattaccatgcttctccactaaaatatgtctgtaaggaagtacccagtacagtatgtctgtaaggaatattccattaaaaggaatatagtgtcgctgtcaattacatttttttttcttttgagatggagtcttgctctgttgccaggctggagtgcaatggtgcaatctcggctctcccgagtagctgggactacaggtgtgcgccaccacgcccagctgatttttgtatttttagtagagatggggtttcaccatgttggcgagatggtctccatctcttgacctcgtgatccacccacctcggcctcccaaagtgctggtattacaggcgtgagccatcacgcctggcctatttacatattttcattaaactcaattttcagagtcattttcagagcacatggatgatagcaagcaagaatctaccaccagtaaagaagaggaaacaaatattataagttccatagttccttcaacacaagatatttatcagcggcagaactcttcagacgttcataaatctctgttgcctgcagtggatgaaactacatgtggtcacacacactttcagcaaatgatagacaagtacattaatgaagcaaatttgatacctgaaaaaacagatttgcaagaattggaacacatttttcctaatttgcatcatcagctgtttaaacccttagaaccacatccagattttgacttatcatcatcatcctctgggatttctccagacaacagagacttttaccagagatcagattcttcatctgaaagccactgtgctactggattatccaaaagtacagtttatttcacagcactgaggaggaccagcatgcattcttctcttaacacaagtccgaatcaacaacctgacactaacttggctcatgttggagctcacagttttgctacagaaaatattattgggggatctgaacaatgttttgaacagcttcagccagaatattcttcacaggaggagagccagcatgctgatctaccaagtatttttagcattgaagcaagagattcttcccaaggcatgaaaaatcagaactatccctctgaagaacatactgaaatattacaaaacaagaaaaaaattgttcatttccagctttctataggaaacttaagttcagtctacagttcatctgatgaagctaatgtatttgatcagttaaatgtacagcatagcactccatgtggttctaactctagtgagtgctcaacaaaacaccaactagaaagcagaaaggaaagtatgggctttgaagaactatcaaaaagaggggttgttacaatgttacaaagtcaaggactcattgaagataataaaaatgaaacctgtagggttttagacataaatccacaggtagaggaaactgactctcgattatgtgtaagaacagtggagatgggaacttcaattcaggcaccatattccttaactactcaaaatgaaaaatattttgagaattcagctgaaacagacattccaaaaatcaccaaaaaactatctcaactaggagaatcagagctttttgcaagttctggatcattttcattacagagctctataccagtctgggaaacagaaactggccatggtataatggaagaaccagaacttactttaataagcaccactgataccagtattgctgaaatggattttgcaaatttaaccctagaagagaagagcgagaatgaagcaaaatgcttctttcaggtgagtgagtttctgcctcttgtatcagcaacagaagcctcagattatccagctgtatcagaactttccatagaaaaaccaaggacagcatctacagcagaaacccctcgcaggcttacacctgtaccagggagcttacaagaagcatttataaagaggaaaaaatcatttatggagagatcccaccagaggcagaaagaaataaggaataaaattcatgtctctgaaaattctcaaatcaaaacagttaaagagaaaccatctataagttcatctgtgagtcgtctaaagggcgtgaataaagtcagagcatcttttcctgaagacagaaagactacacaggctctaaggcaccaaaggggtctaaggttatacaatcaactagctgaagtgaaacaac

SEQ ID NO: 4113 - DNA, 578 bp, Homo sapiens
ctttctgtggtgaggattagcggcagcaaggaatgcagtggagccattaccttgtcaccttctgagcagggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgcacgcctgctgctccaaggactgccccctggcaccacgccccagcgcttggagcagcatgtccaggccttgctgcgggcctcggggctcccagtacagccttgctgtgccttggccagcccccggccagaccgggctctggtccagttgcccaagcccctttctgagg

SEQ ID NO: 4114 - DNA, 500 bp, Homo sapiens
atgctcagcacctggcaggtgtgagggaccaggagcagggttgagaaggttgctgggggcgttgaaggccagccttggccgggggcgggcctggagacccagcactttgtgtgcagagggtgtcatggacacagaggcttggagatcctgagtgaggggcagtgactcaggccccttgcagggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcgg

SEQ ID NO: 4115 - DNA, 3044 bp, Homo sapiens
gtctgtttaaggaatagcagaagacatgacatgtagacaaatttcaggttattttcagaagatactgggtttgttactgtattttaaaaggatactttcttggtttgttatgagatattctaattaaacagtgatgaattcttactcctggtcagtgtaagtctaaattcaagtttgttgctttgttttacagtttcctttcactcccctcccccatcccctcatgagtcataagcatgcagtgttgggaatagaacttgtcagctgagtggggatgagacagttctctgcccatactatttgtaactgtagtcaatgaggagaggaaaggacgttattaaatgctggagaaacaccttgattgaggcagcttcttctgtggctgtgtggtatggatgcagagttctgtgtgactatacactgatgtattctggctctgaatcacttagggatctcttctgcaccttgtgcattgtaggttttggatgcttatttgtttagggtctaggacctggtgcttagcctctcctggatcctgtatatttactgactttccaaattcttttgagtgtggcattatatctgcttcatcttctctttcttggctattcttagtgcccttctcattttactgtcctaatgttttcccatttatactatgaatcattgtgcaccctatgtagagcctgtcattggagattaaaatcagtggcagctctttgattttacagctcagcctcagctgaacataacttctttttttcaaagttccctgtgttgtgaactgagcttgggtgaagtgaaatctttgaggaagctaaagctgtgtgtatttgtggatcagacaagtgcagcaagttaatatcattggcttctgaaggggagagtgaggtgatggctgcgtttaagttggatttccttccagaaatgatggtggatcattgctctttgaattccagtcccgtctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaat

SEQ ID NO: 4116 - DNA, 1991 bp, Homo sapiens
agtctggtgtctcatctctcgccccggaggtcaaacctggagccagcatttctgtaccctgcgctcacacctttttcaacccggatggcggtgatagttaatactttctgagcgcttttactatggtcaggcattatatttacacctaatcctcgcaaaacactactgggaagatcctcatttgacaggagcaattccgggtcacaaaggctgacaccacaaagctagtccgtagcgggttcgaccacaggcgcccacactctttgacgcctcaatggcacagccaagtgcgcgggaagtgggctgcaaacgccggagagttttgtccggagcgcagagacgcgctgtaaccgagcaaccagcggggcccgcccccggcctgctacggcgctcccagcctgccccgcgccgctcggcgccggaagtgagtgagcatttccggcagccatccccgcggtgctgacatcccggttgttcttctgtgccgggggtcttcctgctgtcatgaaggacgtaccgggcttcctacagcagagccagaactccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaaccctttgtccctcgtggaaatcattcttcatgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttc

SEQ ID NO: 4117 - DNA, 805 bp, Homo sapiens
ctttccgccagcgcccgcaggacccggatgagagcgcacgcttcggggtctccgggaagtcgcggcgccttcggatgtggcggatgcggccgtgagccggcgggggagttcctccagatccagctggtgccctcgcctgacgtttgaacgaccacctgctcacctcctcccttttgcgcgttgattcttcagacttcaaagggcccaccggtgctgctgctgcctccactgtactcagacccaggtagcacaggattgtccatcctccagcagctcagtgcaacggtgtgaactcagcctgtttcagagcctccacaccatgacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcacggtgcttatacacaag

SEQ ID NO: 4118 - DNA, 8246 bp, Homo sapiens
gatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattgttaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattc

SEQ ID NO: 4119 - DNA, 844 bp, Homo sapiens
gcggggcggcggggcggccggcggcggccatgggagatatcccagccgtgggcctcagctcctggaaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattttgatccgatttcaaatccagaggaatgtgatagtgatccccggatctatcaccccaagtcacattaaagagaatatccaggtgtttgattttgaattaacacagcacgatatggataacatcctcagcctaaacaggaatctccgactggccatgttccccatgtaaatatggctccttctttttaaaacagagggaagaatatacagattgaatgattggtgtctgaa

SEQ ID NO: 4120 - DNA, 1124 bp, Homo sapiens
tgggtacgtgactccgcccccgggccggtgcaggccctgaggggcgccgagatgtgggagctgctggccgcggcgtgggcagttcaggggctgggcggctgagggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacaggtctcttgtggctcagagcataatttggcaataattgtatctctgcaaggtaagtattattatcccagttttgctgatgtggaaatggagttgcagagaaattaagagatatactcaagatcacagtgttcatgtgtcatggagccatttttgaatcctgtgagagacttcagtgctgatgatcggatgaccagaccatcaaaccatgctggaggtgattttttaattaccattctg

SEQ ID NO: 4121 - DNA, 889 bp, Homo sapiens
gtgactgtcgtgtccaattacagaaaagcctgaatcaagagtatgcagccaaaactactaccaaattattggtaatgggaggagaaaatttaaacagaactgggatttgggaccaccttctggaagatgttagccaaaaaccgaacagatcctaggcatcaaggggtgtgaatttcgagtcaccccgccagaccccagggcgctgcggctcactccacactttcccgggaaccctacgcccaggaggctcagcgaagctccaaaaccaattttacggactgtactactgatccacctgtcggggagaaagactctacccgcagtttgacgaaaatggtcgtttccagatgcttgtaggatttcctcgctaagctccaccctctgcggcgccttcttctgattggctctgagtaatcagagccaaagcgttacttccggcggaaaaggacgcgggagattcgattggaaggctgccggcgtgctactgagttcggccggtccgagtcactgtgcgtcgcctgggcccgttcctggtcttctcccccagggtcttgctctgtcacccaggctggagtgccatggcatcatcatagctcactatggccttgatcctcctgccttagcctcccaagcagctggtattacagaccacggtgtgaacacatgaacagaagacgaaaatttcttctagcctcagtacttgctctccagaattcaagttttatatatccatcatgtcagaagtgcttctctaggataatcctggtctccaaaaggtctaattgtccaaaatgtggctctactggtgaatctggaaatgccaattacagatacaaactttccttaaaagttgcagaatcaaacaaattgtttgttattactgtatttg

SEQ ID NO: 4122 - DNA, 481 bp, Homo sapiens
agacaaggaacagtggaacagttggcttgacgacagcgtcgggacccagccctgcgcaactccacctgcttctgggaacccagggggaagcaagggaagaccgtgacctttgccccgggctgtggggagccccggagcctgggcccggagaagcgcggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagct

SEQ ID NO: 4123 - DNA, 1022 bp, Homo sapiens
ggagaggcccctcctcaggaaatgcgcccgtggaatgctctaccctcttccgcagccagtcgcccctggccttcccaacctcgcggctgcccgaaggacctgttgtgccgggtccggaaagcgtgtttcgctccctttcccttgagggagtggggagggaatgtgactcttttcgcccagcgccgtggactcgcggcttgtggctcccaagttagggagtgagaggatcgcccgccgagggggtggctccgcagcccggctgcgcgagacgcttcccgctcggggacccgccttccgaggccaggtgaacgttaccggccccctgacctccagcagatccacacgtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagttactccattcgccattccataagtatgcctgctatgaggaattctcctactttcaaatcatttgaggagagggttgagacaactgtcacaagcctcaagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagacca

SEQ ID NO: 4124 - DNA, 331 bp, Homo sapiens
gattggaaggctgccggcgtgctactgagttcggccggtccgagtcactgtgcgtcgcctgggcccgttcctggtcttctcccccagaccacggtgtgaacacatgaacagaagacgaaaatttcttctagcctcagtacttgctctccagaattcaagttttatatatccatcatgtcagaagtgcttctctaggataatcctggtctccaaaaggtctaattgtccaaaatgtggctctactggtgaatctggaaatgccaattacagatacaaactttccttaaaagttgcagaatcaaacaaattgtttgttattactgtatttgga

SEQ ID NO: 4125 - DNA, 4949 bp, Homo sapiens
tcgccccttctcggccgccgtagtttttttttttttttaaagaaaaaacggttacccagcaactagaaaaacaaccggaaccggcggcaccagctcggagagaaaggaggtgaggccgcttccccacttcctctccgataccaagacctagccttttcccttcgtctctcttattctctcagcatcccagacacagcctcggagccctgggccgtttgggagccgaggcagcccattctgcgcgagtctgaaatcccaggtcctcaacatcccgcccccgactagacccgtctgccccctccgcccgccctcctctgcccacattggttcagaatctcgccagctcttttcaccactctagaatggttcgatacccccatctactgctccctcagaaaaagcaaaagagaggagtcaggcgtggtggcgcgcgcctgtaatcccaattgctcgggaggctgaggcgggatcatcgctggagcccaggagttcgaggccagagaccccctctcaaagaaaaaaaaagcgatgaaacgagaaccctccatagtctgagcctcattaaaccgtccagttctcccaacctggacccctaccacggcctccgcctctattccgcattgacgcacactctcacattaacaggccaggtcccggaggattcttttcatactcagtagtagctcagcccgctgcttagcagctacccttaatctagcccttgtatttcaagacagaaagagacaacctgatcaagaagaaaccgaaaaatataagaattctaaaactttagaggctgggatttcaaaatcatgacacacagccccatcccatcccatccctccctcacacacacgcacgcacaaccccattccacagtacgaaggtgttcgaagcattgtgggtcatgcttcagaagtggcagcaaggggaaagattgtgcaacttcttcattcaacaaattaatttctagaaccaggactaatttctactctttaaaaaaaaatagacctcaaagaaggtcttctcagcaattgacaatgaatttaactttttagcaatcattctctctaaattcctgtgtgatagcaaaaattacccttaccttttgagcatataaagggtaaagagagaaaaagtcatattgaaaattatgggttttttgcaggattttaaatgatttggcctagtgaatgggtctgtgtttgtattatactaattcacaatggagatttcaaaactctttggaagaaatggatgggcttgggttgtgttagggaaaaaagaattcaagtccagatgtatgagtctcagaaataatttgttggcatagttgtgattatataagtaaaatcagacaaatttaaagacagtactctttaatgaatctttaggttccataggcagttcttaccaagaagatgtcgattccattctccaacacccactaccgaattccacaaggatttgggaatcttcttgaagggctgacacgcgagattctgagagagcaaccggacaatataccagcttttgcagcagcctattttgagagccttctagagaaaagagagaaaaccaactttgatccagcagaatgggggagtaaggtagaagaccgcttctataacaatcatgcattcgaggagcaagaaccacctgagaaaagtgatcctaaacaagaagagtctcagatatctgggaaggaggaagagacatcagtcaccatcttagactcttctgaggaagataaggaaaaagaagaggttgctgctgtcaaaatccaagctgccttccggggacacatagccagagaggaggcaaagaaaatgaaaacaaatagtcttcaaaatgaggaaaaagaggaaaacaagtgaggacactggttttacctccaggaaacatgaaaaataatccaaatccatcaaccttcttattaatgtcatttcttcctgaggaaggaagatttgatgttgtgaaataacattcgttactgttgtgaaaatctgtcatgagcatttgtttaataagcataccattgaaacatgccacttgaagatttctctgagatcatgagtttgtttacacttgtctcaagcctatctatagagacccttggatttagaattatagaactaaagtatctgagattacagagatctcagaggttatgtgttctaactattatcaaatgaataaatcctctctatcacatcccccaaaaatgttctttagctcctgtttcactcctagtggtaaagaatttcactgctttttaaggatagtctatttaattttggaatttttagaaagataagctgggacaaaaatctgcctccttcagcctggccaacatggtgaaaccccatgtctactaaaagtacaaaaattggccaggcgtggtgcgcacacctgtaatcccagctactcgggaggctgaggcaggagaatcgcttgaacctgggaagtggaggctgcagtaagccgagatcgcaccactgcactccagcctgggcgacagagcaagactctgtctcaaaaacaaaacaaaacaaaaaaaagcctctgcctccttgtaagtttaacccactggttttcatttatcatacatgtattcaatcatttattgaaaatgtattgagtactattcatgtgctgggaattagtagtgaatacttgttcttacactcatacaacttacaatgctttattgttttgctctccagaaccacacagaacaagactaataacatcatattgtaaaaagcaaaagctatcatatcatgctgccttcttcagttaaaacttcccaagtttttaaatatacaatggtaatgcctgtttaacaaactcagaggctttatctcttttatgttttcaatgattcattcaaatccctagtgccttagttttagaaagttccgtctctcctttttgaggcctctccacccttgattgtccaagaaactgagggttcatgtcttagaccaaagggtgcagttctcttcccaatacaaaaggtagaaagtggagtcttaccatttagttaatgctgttgccttctaccataatgttgtagcatagtccagcagactgaggtgattctctggctggttccaattcctgcctgcaccatagtggatggcccatgatttagttccaggattacatctctcttggtttatagtcacaaagccagtgttcccccaaagcttaaaaacaagccaggatggctcagtcctgaggagattctaaaaccaggtctatgttgtcacaacaaatactctcctacaaacactttgatccttgtcctaggcttagacatgctctttctgcaaagcagttttatttcaggtgcctcactgcccttccctggcactgagcctttatcaggctctgcaacagaggttcccccaagtgatcgccactcaaacacagttgattcacaccaaccctttcaaggttgtggctttcattctctaatgtccactcatacaggcagcctttctccttccaaaatcttgctgccactgtagagagtttcatgctagctaaacacaagtctctaatatcccccttcctctcctccttaacccctctcctccaggcttacagaggaaaagaaatcagttctcctccaggattccagctgttcgtccctcccattccactgaaagcaccagcttctaacaccttcccctctcagacagagccatcctgcttagcggattgtcaaggggggacccagaatttatgcaaagacttagattccctgacctggagagatcagaagaggaaaaaagggattttttccctagtgagtatatagcaggaaaaaaaaaaaagatgagttagctttttcagtaattctcctgttatacacataaagtgactagcactatgcattccatacacacacacacacacacacagatctcatggtagtgatattggtagtgaaggaggaaaaggaaaaggtgagcaatggatgtgatattatgagaacaacacatatgaatgacactttattagaacttatctggttttcctcttatctctctggctgttccttctcaattcccttcactggtaactcttcaactccccaaccactaaatgctaagtgcccttaggctcagtctttcgaccccatttctacactcacttgatttcctgcagtttcatagctttaaaatccaatcttcttaatgatcactcccagacctttctctcctctgcctgcgaacttctatattcaactgcctacataacatccccatttggatgtctataggcatctcaaaagtaacatataaaaaatgaatcctgatattgcccccaaatctgaaacttcccccacacccaagtttttccattcaaaaatggctgctccattcttccatttgctcaggccaaaaaccttggattcatctttaatgcgtcactttctttcacaccccatatacaatctatcagcaaaacctgtgggctgtacctataaaataatactcagaatctgcctacttctaaccacttccattgttaccgccttggtcctagttcccatgatagccttgtgaattattgcaataacctatattggccagtgattatctcactactactgcacaacccattccaaagttagtggtttaagacaattatattttctcctgggtctgtaggtcagtggtaatgtagctaagctaggctggactacaatctcaaggttaggttcaggtcagctctaagctgtgggtttgtgggctgacaggaaggtctgcttcaggctgtgggcccaagggtcagctgcagcacagtgcctctgcttcacgtgtccttttctgagcccctgctgaaagacgttatccaggacaagctcttctcatgctggtcacagaagacaagcaggaaaacccagcatgcaagaatatttcaagcttttgctc

SEQ ID NO: 4126 - DNA, 555 bp, Homo sapiens
tttggaggtccggcacccgctctgcccatgcctatgcttcaggctctgtgagaaggctggactccttctggaacttcaggaccttggatgctcccctcctctgctcctgcctcccttcccccagccctggggtgtgtcagatgtgtgttttctcctggactcagctgaagcaaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaag

SEQ ID NO: 4127 - DNA, 1708 bp, Homo sapiens
tgcgtcttcctgactctagtacgttgaatctggccagaaaaaccacatttgctctctacgaactctccgcccagttcgccgcaactactacgacccctcctcggcccctgggaagggcgtggtgtgggagtgggagaacgacaatggctcctggacgccctacgacatggaagtgggcatcaccatccagcatgcctatgagaagcagcacccctggatcgacctcacttccattggctttagctacgtaattgacttcaacaccatgggccagatcaaccgtcagacccagcgccaacgccgcgtccgccggcgcctcgacctcatctaccccatggtcacagggaccttgcctaaggctcagtcctggccagtcagccctgggccagccacctcgccccccatgtccccctgctcctgtccccagtgtgtcttggtgatgagtgttaaggcagccgtggtcaatggcagcactgggcccctacagctgccagtgacccgcaagaacatgccgcctcctggagtggtcaagctacccccactgccaggctctggggccaagccactggacagcacaggcaccattcgaggcccactgaagaccgccccatcgcaggtgatccggagacaagcctccagcatgcccactgggacaaccatgggctctcctgccagtcccccaggacccaacagcaagaccggaagggtggccctggccaccttgaatcgtaccaacctgcagcgactggccattgcccagtcccgggtgctgatcgcctctggggtccccacagtcccagtgaagaacctaaatgggtccagtcctgtcaaccctgccttggcaggaatcactgggatcctcatgagtgcagcggggctgcctgtgtgtctcaccaggccaccaaagctggtcctacacccaccccccgtcagcaagagtgaaataaaatccatcccaggggtttccaacacaagccgcaagaccaccaaaaaacaagccaagaaaggtaaaaccccagaggaagtgctaaaaaaatatctacagaaagtccggcacccaccagatgaggactgcaccatctgtatggaacgcctcacggccccctcaggctacaagggcccgcagcctacggtaaaacctgacctggtagggaagctgtccagatgcggccacgtctaccacatctactgcttggttgccatgtacaacaatgggaacaaggatggaagtttgcagtgtccaacctgcaagaccatttatggggtgaagacaggcacccaacctccagggaagatggagtaccacctcatcccccactccttgcctggccacccagactgcaaaaccatccggatcatctacagcatcccccccggcattcagggaccggaacacccgaatcctgggaagagtttcagcgcccgaggcttcccacgacactgttaccttccggacagcgagaaagggagaaaagttctgaagctgctgctcgtggcctgggatcgccgcctcatttttgccattggcacctccagcaccacaggcgagtcagacaccgtcatctggaatgaggtccaccacaagacagagtttggctctaatctcactggccatggctacccagatgccaattacctggataatgtgctggctgaactggctgcccagggcatctctgaggacagcactgcccaggagaaggactga

SEQ ID NO: 4128 - DNA, 683 bp, Homo sapiens
ctctcccccactgttagacctcagcagccagcagcccgccgcccggcgctgcagctccctgcccgcaggagccacgtctcgcgcgactccccccacctctcgcgacacttgccgcccgtgccctgcggccctgcacgccccacccgcggtcgcgcgccgcgctccccgccgcctcaccttttcgcctggcatccgggcccgctactcgcccactgggagcgccgtggcgcctggtgttcggcgcgagcccggcggggctgcagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagagg

SEQ ID NO: 4129 - DNA, 551 bp, Homo sapiens
attttgggcgcttcgctgatggtgtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaaaaatttcgttctttgccctgtgctcagaagatcacaataaaacttcaccacatcaagctgctgtgggatagggcaaaccgggatggttaagtccatgagtgcatgaagtttactgttggtgctactggttcagtaacaggtgatggatttcaaaagtctccagatgcctgctggcgaataatcaaagaataactaccagcatgttttggaaatttgatcttcactcatcatcccacatagacacacttctagaaagagaagatgtaacactgaaggagttaatggatgaggaagatgttttacaggaatgtaaagct

SEQ ID NO: 4130 - DNA, 7606 bp, Homo sapiens
gtcattgagctgatgtgcttttgcaaggggtctctttagaagtggtaggggcagggtcgagagaagaaggggatgcagaatctgtacatgaggaaggagccagagtcactcaggaaactcctcattcttcctgcgctggctgtggcacacccaccggtggcacacccctccctcgggtccagttcagcccacagactcctgggaggagagccagggccccagcctctcctttgaggagtgttgcagcctttctgtgtgccagatgcctagtgaagaaaagctgaaaccctggagctttgtgcatgttaatgaccttggaaatgactgagctcacggaccctcatcacaccatgggagactacaaagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagatttccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgt

SEQ ID NO: 4131 - DNA, 3266 bp, Homo sapiens
gtgactccgcaacctgtcgctcaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcaggaccctcccgagggcctgaccgtggaggtagcactgcacacccactccctgtgggccggagccaggaggcacttcctgggtgtcggagcccagaaggaaaccagtggccgggaagcaccagctgggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgctgcggctgctggacatcgagtcacaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggcagagctggtgcacgaggacatcgagagcgcgttggccgactgccggctgggcaagaagatgcggccgcagaccctgaagggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcagagggcgtcctcacactgcgggcacggcccccctctgagggcgagttcatcgactgcttccagaaaatcaagctggcgattaacttgctggcaaagctgcagaagcacatccagaaccccagcgccgcggagctcgtgcacttcctcttcgggcctctggacctgatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggagggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctcccctgtgcacctggggggtcctggcccctgtgatgctcccccatccccacccacttctacatccatccacaccccagggtgagctggagctccaggctggccaggctgaacctcgcacacacgcagagttctgctccctgaggggggcccgggaggggctccagcaggaggccgtgggtgccattcgggggaaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtctccca

SEQ ID NO: 4132 - DNA, 1021 bp, Homo sapiens
ccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcaggtgagggtgactgttgactagtgaaaaaagggacccatggttcacgactgtcttcttactggcagtggaacgacctgtggaaacctgtgatccattctcattaaataaatctctggcatcttggactcaagtgattctcctgcctcagcctcctgagtagctgggactacaggacagaaaattttaataacaagatagtaagcagctcacatgaacttacatattcagcatattagcaggaaagaggcaagacatttgaagaacttgcagaaaagttgcaaagtaaatgagagactagaatgctcaaagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaac

SEQ ID NO: 4133 - DNA, 586 bp, Homo sapiens
agactaccggcggcgacgaccacaggagagacggggtttcaccacatctctggtcatggtcatggccaggctggttttgaactcctgacctcaagtgatccacccacctcggcctcccaaagtgctgggattacaggcgtgagccactgcaccggtcctggctaagcatggcggacaccgacctgttcatggaatgtgaggaggaggagttggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagccccaggtctgggcacaatggttactcaaccagtattgaggcctgttcaggtcatgcagaatgccaatcatgtgactag

SEQ ID NO: 4134 - DNA, 819 bp, Homo sapiens
tgcctgacattgtgtagctgtatcaggctggctttctggaatagctcagtggccaaagattgatcacgaagggtttagagctgtgaaaatgccccagaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagccgccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgtggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattttattaagacctctactggaaaagaaacagtaaatgccaccttcccggtagctatagtaatgctgcgggccattagagatttcttctggaaaactggaaacaaggta

SEQ ID NO: 4135 - DNA, 550 bp, Homo sapiens
tcggctcactgcaccctccgcctcctgggttcaagcgattctcctccttcagcttcctcagtagctgggattacaggcacgcgccaccacacctggcatggcggacaccgacctgttcatggaatgtgaggaggaggagttggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcact

SEQ ID NO: 4136 - DNA, 587 bp, Homo sapiens
acgcaccggcgagcgccgaggggacaggccgagcgcggggcgccggaggcagctctggggcttggtgggggcaatccctgcgtccggagagcgctggtggtagggaggcttctcccggttctgtgagcagcaggaccctcccgagggcctgaccgtggaggtagcactgcacacccactccctgtgggccggagccaggaggcacttcctgggtgtcggagcccagaaggaaaccagtggccgggaagcaccagctgggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaa

SEQ ID NO: 4137 - DNA, 492 bp, Homo sapiens
ggactgagggaagaagtgaaaatcggactgccaggcgacagttcctccgtttgaaatctcgccggctcctgagcgggccaccgggcccgggctgggggtctggcgggtgtttgagcccagatgagtcatggctggacgacccctccgcataggagatcagctggttctggaagaagattatgatgagacctacattcctagtgagcaagaaattcttgaatttgcccgggagattggtattgatcccatcaaggaaccagaactgatgtggctggcgcgagagggcatcgtggccccactgcctggagagtggaaaccatgccaggacatcacaggtgacatttactatttcaacttcgccaacgggcagtctatgtgggaccatccatgtgacgaacactatcggagcttggtgatccaagagcgggcaaagctgtcaacttctggggccattaagaagaagaaaaaaaaaaaggaaaagaaagacaagaa

SEQ ID NO: 4138 - DNA, 3533 bp, Homo sapiens
gggagattcgattggaaggctgccggcgtgctactgagttcggccggtccgagtcactgtgcgtcgcctgggcccgttcctggtcttctcccccagggtcttgctctgtcacccaggctggagtgccatggcatcatcatagctcactatggccttgatcctcctgccttagcctcccaagcagctggtattacagaccacggtgtgaacacatgaacagaagacgaaaatttcttctagcctcagtacttgctctccagaattcaagttttatatatccatcatgtcagaagtgcttctctaggataatcctggtctccaaaaggtctaattgtccaaaatgtggctctactggtgaatctggaaatgccaattacagatacaaactttccttaaaagttgcagaatcaaacaaattgtttgttattactgtatttggaagttgcttagatacattttttggtcttactgccactggtttgcacaggtacattcaggatcctaataaaattccagaaacactggacaatgatacaactcagaatctattaactaaagcagttgaaacttgctttgttggacaaagctttatttttggagtgacgaattttgaaaaccaacctggacaaggttcagatgccagtaacttcttacagcaatgctctgaccacaaaagaaaagccaaagcactagtggcttgccagattgttctaccagacccaggtattgcaggctttactgtcattgactacttccatcaacttttgcagacttttaatttcaggaaacttcagtgtgactctcaggcacctaacaatcacttacttgctttagatcactcaaatagtgatctcagcagcatatatacttctgacagcacttctgattttttcaagtcctgcagcaaggatactttttcaaaattctggcagccatcacttgaattcacttgcattgtttcacaactaacagataatgatgatttttcagcttcagaacaaagtaaggcctttggtactcttcagcagaacagaaagtccatctccattgcagaggccactggttccagtagctgccatgatcccattcaggattcatggagccttgtttcatatatggataaaaagagtacagcagaaaagttgggtaaagaacttggcttacaagctaaggagctgagtgcagttcacagcagtcatcatgaaattggagttaatgactctaatttattctctttggaaatgcgagagccccttgagtcaagtaatacaaaatccttccacagtgcagtggaaattaaaaataggtcccagcatgagctaccatgttttcagcatcatggtatagataccccaactagccttcagaagagatctgcatgttgtccaccttcgttactcagacttgaagagacagccagcagttcccaggatggtgaccctcaaatttgggatgatctgccattctctgaaagcctgaacaagtttctggcagttcttgaaagtgagattgctgtaacccaggcagatgtcagtagtaggaaacatcatgtagataatgacattgataaatttcatgcagaccacagcaggttatctgtgactccccagagaactactggagccctgcatacaccacctatagctttaagatcatcacaagtaatagtcaaagcaaactgtagcaaagatgacttccttttcaactgtaaaggaaatctaagtcctagtgttgaaaaggagtcacaaccagataacaaagtagaggctgtctctgtaaatcataatggaagagatatgtcagaatattttttaccgaatccttacctgtcagctctgtcttcatcttcaaaagatttagaaacaatagttactcttaagaagactatcagaatctcaccacacagggagagtgaccattctagtctaaataacaaatatttgaatggatgtggagaaatatcagtttcagaaatgaatgaaaagttgacaactctgtgttataggaagtataatgatgtctctgatctttgcaaattagaaaataaacaatattgtaggtggtccaagaaccaagatgacagttttacaatttgcaggaaacttacatatcctttagaaactctttgcaatagtccaaatagaagtacaaatacattgaaagaaatgccttggggacatatcaataacaacgtaacacagagctattctattggttatgaaggtagctatgatgcctctgctgatctctttgatgatattgctaaagaaatggacattgcaactgagattaccaaaaaatcacaggatattttgttaaaatggggaacatctttggcagaaagtcacccttcagagtctgatttttcactgagatcactttctgaagacttcatccagccttcacaaaaattatccttgcaaagcctatctgactctaggcattcaagaacatgctctccaacacctcattttcaatcagattcagaatataattttgaaaatagtcaagactttgttccatgttcacagtcaactccaatttcagggttccaccaaacaagaattcatgggataaacagagctttcaaaaaacctgtattttattcagatcttgatggtaactatgaaaaaataaggattttccctgaaaatgacaaacagcaagccagcccaagctgtccaaaaaatataaaaacacctagccagaaaatcagaagccctattgtatctggtgtttcacaaccagacgttttcaatcactacccttttgctgagtgccatgaaactgatagtgatgaatgggtccctcctaccacacaaaaaatatttccttcagatatgcttggattccaaggcataggtctagggaaatgccttgctgcctatcatttccctgatcaacaagagttaccaagaaagaaactgaaacatattagacaaggaaccaataaaggtttaattaagaagaaattaaagaatatgcttgcagcagttgttacgaaaaagaaaactcataaatataactgtaaaagttcaggctggatttccaaatgtccagacattcaagtcttagcagcacctcagctgcaccctattcttggacctgattcttgttcagaagtcaaatgttgccttccattttcagaaaaaggcccaccttcagtgtgtgaaactcgaagtgcttggtcacctgaattgttttcataaaaagtcacctgaacccaattcctgaacttttaaatctgtttggaaatgtttgccttcaggggtacggaaagcattctttacattttgaacacttggagagaagcaaattgaaaacaggactctgctgggagctactgtgccttttaaaatataaagccattgttttccccagggttttatctagaatactatgattaggtagttgagcactttatcttatactgtttattgtactttaataatattgttaagattgtttttgaaagtattaatgtttgttaaaatcacatatacatccagaaataaagactttgcaaaccaaaa

SEQ ID NO: 4139 - DNA, 570 bp, Homo sapiens
agttttgaaaatcatagttttcgcccgcgctgcgccgcctggttgctcctcccgtgcgacagagccaccatggggacgacggccccagggcccattcacctgctggagctatgtgaccagaagctcatggagtttctctgcaacatggataataaggacttggtgtggcttgaggaaatccaagaggaggccgagcgcatgttcaccagagaattcagcaaagagccagagctgatgcccaaaacaccttctcagaagaaccgacggaagaagagacggatttcttatgttcaggatgaaaacagagatcccatcaggagaaggttatcccgcagaaagtctcggagcagccagctgagctcccgacgcctccgcagcaaggacagtgtagagaagctggctacagtggtcggggagaacggctccgtcctgcggcgtgtgacccgtgctgcggctgcagctgccgcggctaccatggcattggctgcaccttcttcacccacccctgagtctcccacgatgctgactaagaagcccgaggataaccacacccagtgccagctggtgcct

SEQ ID NO: 4140 - DNA, 2356 bp, Homo sapiens
tagcgccgggagtgggtgccttccgccggctgtacagagcgccggcaggtggcgcccagcggcgagcttgttccagcttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagttactccattcgccattccataagtatgcctgctatgaggaattctcctactttcaaatcatttgaggagagggttgagacaactgtcacaagcctcaagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatgactttgaattcttaatttctttgtcttaaaagttgctagttatgattttacagatgcaattttaaatcaacttttagccaggtgcggcggctcacacctgtaatcccaactattttggatgccaaggtgagaggattgcttgaggccaggagttaaagatcagcctgggcaacacagaccctgtctctacaaaaaaagaaaaaaattagccagacatagtgttgcttgcctgtagtcccagctactctagaggctgaggcaggaggattgcatgagcctaggagttcgaaactgcagtgagctatgattgcaccactgcactactccagcctgggtgacagagtgggacactgtctccaaaaatagtaataataagtagtcaacttttactgctaatttggtgaacatgagagaggatatgaaaataaatattacctcagctatcctaggatgttaaaataatctccaattttaaaattctctccaatctacatacagtagtagttagtcagataaaggatatccaaaaaagagatagctagaaaatgggagaagcagagttctgcaacccctttcagtttgtaaattgttcacatgtatgaaaataactggtatttatcaatccactcagatttctgcactaacttttatcttatatatcatatgtatctcttttctttttctaaatgggaacatatatttgttattaggtggcagagatatagccttaagatatatttgtaaaatgcacactgaatagacatccaacctaaaaaaaatcactatttaaaaagcccatataatatatacatatttgttagcatgctaattgttcatgttttgtgtttattaaatagaagtgatatatatgacattttgaagtaaagcacatctgaaaaattctactcaaa

SEQ ID NO: 4141 - DNA, 1426 bp, Homo sapiens
gaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtggatcctgctggagccaaaattggaaatggaggatcaacactttgtgcccttcaatgtttggaaaagctatatggagataaatggaattcttttaccatcttattaattcactctggtggctacagtcaacgacttccaaatgcaagtgctctgggaaaaattttcactgctttacctcttgatataccagaatgctctggcaaaacatcctgtatcattcaaagcatactggattcaagatgttctgtggcacctggctcagttgtggagtattccagattggggcctgatgtttcagttggggaaaactgcattattagtggttcttacatcctaacaaaagctgccctccccgcacattcttttgtatgttccttaagcttaaagatgaatagatgcttaaagtatgcaactatggcatttggagtgcaagacaacttgaaaaagagtgtgaaaacattgtcagatataaagttacttcaattctttggagtctgtttcctgtcatgcttagatgtttggaatcttaaagttacagaggaactgttctctggtaacaagacatgtctgagtttgtggactgcacgcattttcccagtttgttcttctttgagtgactcagttataacatccctaaagatgttaaatgctgttaagaacaagtcagcattcagcctgaatagctataagttgctgtccattgaagaaatgcttatctacaaagatgtagaagatatgataacttacagggaacaaatttttctagaaatcagtttaaaaagcagtttgatgtagagatattttaaatattgtacactttgcctttttgagtaacattccagagataggtattttttgtaggctgtttcactgaactcagttaatgaaaactgtattaacataattgttgtagcataatattaatagtgcaaaagtacatataagtcattttgatgaaaaatattccaagactaagttgagaaaagagatactattttggatgtgtatcagtatttttgtttttaataatgattgatttgtggagcattgttttttcacataattagttttaaaggtaattttctaagcatacctttggaatttttccatcttttttgaggcttttggtccagtgaagttctaagtattcactggcacttctctcctcaactgtaattctattttt

SEQ ID NO: 4142 - DNA, 943 bp, Homo sapiens
tcggctttcttctcgtcggtgttcccggctgctatagagccgggtccccgcggaagccgcggtgtcggcgccatggcggagctgacggctcttgagagtctcatcgagatgggcttccccaggggacgcgcggagaaggctctggccctcacagggaaccagggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattg

SEQ ID NO: 4143 - DNA, 811 bp, Homo sapiens
gcggcttgtggctcccaagttagggagtgagaggatcgcccgccgagggggtggctccgcagcccggctgcgcgagacgcttcccgctcggggacccgccttccgaggccaggtgaacgttaccggccccctgacctccagcagatccacacgtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtat

SEQ ID NO: 4144 - DNA, 684 bp, Homo sapiens
gccattctcctgcctcagcctcctgagtagctgggactacaggtgcccgccaccaggcccggctaattttttgtatttttagtagaggcggggttttgcagtgttaaccaggatggtctcgatctcctgaccttgtgatcagcccaccttggcctcccaaagtgctgggattacaggcttgagccaccgcgcctggcccagcttttcttttattagatagcaatgaggatgggatccgaagtagagcttccaacgaccctcaggagcgctgagcgaccaagtgaagtacctacaggacccatttgtgttcactgatctattggagcagctggggattgtggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatc

SEQ ID NO: 4145 - DNA, 4189 bp, Homo sapiens
cgcgggcggcggtgctaggctcgcctctgcctccctcgtggcgggcccggacatggggtcccgtggcctgagtccctcggccggcgcgcagggctcggggccgcgcgcagcctccccgcactgactgtcgcgccgtgccctgcgccaggaggagcggaggccgcgcgcggcccgccgagcgccttcaggatgctcatcaaggaataccacattctgctgcccatgagcctggacgagtaccaggtggcccagctctacatgatccagaaaaagagccgggaggagtctagtggtgagggcagcggcgtggagatcctggccaaccggccctacacggatgggcccgggggcagcgggcaatacacacacaaggtgtaccacgtgggctcccacatcccaggctggttccgggcactgctgcccaaggctgccctgcaggtagaagaggaatcctggaatgcctacccctacacccgaacccggtacacctgccctttcgtggagaaattctccattgaaattgagacctattacctgcctgatggggggcagcagccaaacgtcttcaacctgagcggggccgagaggagacagcgcatcctggacaccatcgacatcgtgcgggatgcagtggccccaggcgagtacaaagcagaagaggacccccggctttatcactcggtcaagacgggccgagggccactgtctgatgactgggcacggacggcggcacagacggggccccttatgtgtgcctataagctgtgcaaggttgagttccgctactggggcatgcaagccaagatcgagcagttcatccatgatgtaggtctgcgtcgggtgatgctgcgggcccaccgccaggcctggtgctggcaggatgagtggacagagctgagcatggctgacatccgggcactggaagaggagactgctcgcatgctggcccagcgcatggccaagtgcaacacaggcagtgaggggtccgaggcccagccccccgggaaaccgagcaccgaggcccggtctgcggccagcaacactggcacccccgatgggcctgaggcccccccaggcccagatgcctcccccgatgccagctttgggaagcagtggtcctcatcctcccgttcctcctactcatcccaacatggaggggctgtgtctccccagagcttgtctgagtggcgcatgcagaacattgcccgagactctgagaacagctccgaggaagagttctttgatgcccacgaaggcttctcggacagtgaggaggtcttccccaaggagatgaccaagtggaactccaatgacttcattgatgcctttgcctccccagtggaggcagagggaacgccagagcctggagccgaggcagctaaaggcattgaggatggggcccaagcacccagggactcagagggcctggatggagccggggagctgggggctgaggcatgcgcagtccacgccctcttccttatcctgcacagcggcaacatcctggactcaggccctggagacgccaactccaagcaggcggatgtgcagacgctgagctccgccttcgaggccgtcacccgcatccacttccctgaggccttgggccacgtggcgctgcgactggtgccctgtccacccatctgcgccgccgcctatgcccttgtctccaacctgagcccttacagccacgatggggacagcctgtctcgctcccaagaccacattccactggctgccctgccactgctggccacctcatcctcccgctaccagggcgccgtggccaccgtcattgcccgcaccaaccaggcctactcagccttcctgcgctcacctgagggtgccggcttctgtgggcaggtcgcactgattggagatggtgttggtggcatcctgggctttgatgcactctgccacagtgctaacgcgggcaccgggagtcggggcagcagccgccgtgggagcatgaacaatgagctgctctctccggagtttggcccagtgcgggaccccctggcagatggtgtggaaggcctgggtcggggcagcccagaaccctcggccttgcctccccagcgcatccccagcgacatggccagtcctgagcccgagggctctcagaacagccttcaggcagcccccgcaaccacctcctcctgggagccccggcgggcaagcacggccttctgcccacccgctgccagttccgaggcacctgacggccccagcagcactgcccgccttgacttcaaggtctctggcttcttcctcttcggctccccactgggcctggtgctggctctgcgcaaaactgtgatgcccgccctggaggcagcccagatgcgcccagcctgtgaacagatctacaacctcttccacgcggctgacccctgcgcctcacgcctcgagcccctgctggccccgaagttccaggccatcgccccactgaccgtgccccgctaccagaagttccccctgggagatggctcatccctgctgctggccgacactctgcagacgcactccagcctctttctggaggagctggagatgctggtgccctcaacacccacctctactagcggtgccttctggaagggcagtgagttggccactgaccccccggcccagccagccgcccccagcaccaccagtgaggtggttaagatcctggagcgctggtgggggaccaagcggatcgactactcgctgtactgccccgaggcgctcaccgcctttcccaccgtcacgctgccccacctcttccacgccagctactgggagtccgccgacgtggtggcgttcatcctgcgccaggtgatcgagaaggagcggccacagctggcggaatgcgaggagccgtccatctacagcccggccttccccagggagaagtggcagcgaaaacgcacgcaggtcaagatccggaacgtcacttccaaccaccgggcgagcgacacggtggtgtgcgagggccgcccccaggtgctaagcgggcgcttcatgtacgggcccctggacgtcgtcacgctcactggagagaaggtggatgtctacatcatgacgcagccgctgtcgggcaagtggatccactttggcaccgaagtcaccaatagctcgggccgcctcaccttcccagttcccccagaacgcgcgctgggcattggtgtctaccccgtgcgcatggtggtcaggggcgaccacacctatgccgaatgctgcctgactgtggtggcccgcggcacggaggctgtggtcttcagcatcgacggctccttcaccgccagcgtctccatcatgggcagcgaccccaaggtgcgagctggcgccgtggacgtggtcaggcactggcaggactccggctacctgatcgtgtatgtcacaggccggccggatatgcagaagcaccgcgtggtggcatggctgtcgcagcacaacttcccccacggcgtcgtctccttctgcgacggcctcacccacgacccactacgccagaaggcaatgtttctgcagagcctggtgcaggaggtagaactgaacatcgtggccggttatgggtctcccaaagatgtggctgtatacgcggcgctggggctgtccccgagccagacctacatcgtgggccgtgccgtgcggaagctacaggcgcagtgccagttcctgtcagacggctatgtggcccacctgggccagctggaagcgggctcgcactcgcatgcctcctcgggacccccgagagctgccttgggcaagagcagctatggtgtggctgcccccgtggacttcctgcgcaaacagagccagctgcttcgctcgaggggccccagccaggcggagcgtgagggcccgggaacaccacccaccaccctggcacggggcaaagcacggagcatcagcctgaagctggacagcgaggagtgaggcccacaccagcctggacctgggttatttattgacacacccaaggggcccgaggggctgcgtgtgggaggctggggacccagacttttggccccagcgctggcccccccagccccacaccctatatctccgtgtgctcctcggtgttacttccctttcatatgaggggacccagcgccggggggagggaggagggcgtgggcatgggcgcagaggcttttccagtgtgtataaatccatgaaaataaacgccacctgcacccca

SEQ ID NO: 4146 - DNA, 2936 bp, Homo sapiens
aaacggagcccttaaagggcaatgctctgcgtgtgccacggtgcccaacagcatctcgtgccagctgagctgcggtgtgtggacccggggaatggaccgggctggacaacctctaagacttggctccagctcagcctgtgaaggaatcacctctctgatccccacctctgccccggagtgctagacccagggaggaagagaccccatggaccagccagaggccccctgctccagcacggggccgcgcctcgcggtggcccgcgagctgctcctggctgcgctggaggaactgagccaagagcagctgaagcgcttccgccacaagctgcgcgacgtgggcccggacggacgcagcatcccgtgggggcggctggagcgcgcggacgccgtggacctcgcggagcagctggcccagttctacggcccggagcctgccctggaggtggcccgcaagaccctcaagagggcggacgcgcgcgacgtggcggcgcagctccaggagcggcggctgcagcggctcgggctcggctccgggacgctgctctccgtgtccgagtacaagaagaagtaccgggagcacgtgctgcagctgcacgctcgggtgaaggagaggaacgcccgctccgtgaagatcaccaagcgcttcaccaagctgctcatcgcgcccgagagcgccgccccggaggaggcgatggggcccgcggaagagcctgagccggggcgcgcgcggcgctcggacacgcacactttcaaccgcctcttccgccgcgacgaggagggccggcggccgctgaccgtggtgctgcagggcccggcgggcatcggcaagaccatggcggccaaaaagatcctgtacgactgggcggcgggcaagctgtaccagggccaggtggacttcgccttcttcatgccctgcggcgagctgctggagaggccgggcacgcgcagcctggctgacctgatcctggaccagtgccccgaccgcggcgcgccggtgccgcagatgctggcccagccgcagcggctgctcttcatcctggacggcgcggacgagctgccggcgctggggggccccgaggccgcgccctgcacagaccccttcgaggcggcgagcggcgcgcgggtgctaggcgggctgctgagcaaggcgctgctgcccacggccctcctgctggtgaccacgcgcgccgccgcccccgggaggctgcagggccgcctgtgttccccgcagtgcgccgaggtgcgcggcttctccgacaaggacaagaagaagtatttctacaagtatttccgggatgagaggagggccgagcgcgcctaccgcttcgtgaaggagaacgagacgctgttcgcgctgtgcttcgtgcccttcgtgtgctggatcgtgtgcaccgtgctgcgccagcagctggagctcggtcgggacctgtcgcgcacgtccaagaccaccacgtcagtgtacctgcttttcatcaccagcgttctgagctcggctccggtagccgacgggccccggttgcagggcgacctgcgcaatctgtgccgcctggcccgcgagggcgtcctcggacgcagggcgcagtttgccgagaaggaactggagcaactggagcttcgtggctccaaagtgcagacgctgtttctcagcaaaaaggagctgccgggcgtgctggagacagaggtcacctaccagttcatcgaccagagcttccaggagttcctcgcggcactgtcctacctgctggaggacggcggggtgcccaggaccgcggctggcggcgttgggacactcctgcgtggggacgcccagccgcacagccacttggtgctcaccacgcgcttcctcttcggactgctgagcgcggagcggatgcgcgacatcgagcgccacttcggctgcatggtttcagagcgtgtgaagcaggaggccctgcggtgggtgcagggacagggacagggctgccccggagtggcaccagaggtgaccgagggggccaaagggctcgaggacaccgaagagccagaggaggaggaggagggagaggagcccaactacccactggagttgctgtactgcctgtacgagacgcaggaggacgcgtttgtgcgccaagccctgtgccggttcccggagctggcgctgcagcgagtgcgcttctgccgcatggacgtggctgttctgagctactgcgtgaggtgctgccctgctggacaggcactgcggctgatcagctgcagattggttgctgcgcaggagaagaagaagaagagcctggggaagcggctccaggccagcctgggtggcggcagttctcaaggcaccacaaaacaactgccagcctcccttcttcatccactctttcaggcaatgactgacccactgtgccatctgagcagcctcacgctgtcccactgcaaactccctgacgcggtctgccgagacctttctgaggccctgagggcagcccccgcactgacggagctgggcctcctccacaacaggctcagtgaggcgggactgcgtatgctgagtgagggcctagcctggccgcagtgcagggtgcagacggtcagggtacagctgcctgacccccagcgagggctccagtacctggtgggtatgcttcggcagagccctgccctgaccaccctggatctcagcggctgccaactgcccgcccccatggtgacctacctgtgtgcagtcctgcagcaccagggatgcggcctgcagaccctcagtctggcctctgtggagctgagcgagcagtcactacaggagcttcaggctgtgaagagagcaaagccggatctggtcatcacacacccagcgctggacggccacccacaacctcccaaggaactcatctcgaccttctgaggctctggtggccagagcagggtggaagaccctagtcaaagtccctgtggagaga

SEQ ID NO: 4147 - DNA, 474 bp, Homo sapiens
gagacctggcgccccggccgaggcgcgaacagacggacgcaccggcgagcgccgaggggacaggccgagcgcggggcgccggaggcagtccctcccctaggcttggctgctgccaggggttctgcgctggccacctggccgcatccctgccctcgaggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgca

SEQ ID NO: 4148 - DNA, 2076 bp, Homo sapiens
attatcctccttattgacaaacagagcggtcgcggcggcgactctcggcgtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataacatagtgcaagctgcctaaatatgtattatttgagaattgtgaaacagatagttatatgtatacaagtcaaagaacaacttaactattgctgcaacaggtttttcttaatggttatcctcttaaatacacctgctggtacttggtgtggttaaataggaaaattgttattaaataaagaatttgtatgaacctttgccaatgtttttgacacgttttactaattattgttcctgaattatgtttctggttttatctattttttgaggtttttttgtttgcttatttttcaaaacattcatttattgtaatgtttactagcggactagtaaacaataaaacattgattatttagctttataattcaggtttagtgctattgtcattgaacactggtattttctgtatcatataaaacattaaaattcaaataattataagcatttggcaaaaacaagagaaaagaaacttgccatattttacaagctgcaattttagaaaagctttaacttaatgatagttttatcattgttttcttgtcccaaacttatccagggccatagaagtatgaatctaattaaaacagaaatgggaattattgcacagaaatgggaaataactaattttaaatcagtcaaattggcttcttattaaatacaataattcttatgaaaatcatagtaccctattttcagacacagctgccagtttacacatttctcagtatcctgaaaggaaaaaagtatagccccacttatactatgtaaaattaccaataaaatatttttatgactacagattttgcatttttgtttacaactatttaaagagttttatgttgtatttagaatttcaacctagaaaccacacagtacttaaattctcctggggtctcctgctttctcttaaccatttgcttaatatatatctacctaaaggagacttctgaattgtaaatgaacttaaaaatagaatgtggatgcaaaatatcacataagacatcatgataacatttgaagaaaaaataaaactgtagaccctaacagttgtgatatttggtggtttcatgtggtaatgtaattttctgtttaattacagtactttttacaggcaca

SEQ ID NO: 4149 - DNA, 3335 bp, Homo sapiens
cacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagtacagccttgctgtgccttggccagcccccggccagaccgggctctggtccagttgcccaagcccctttctgaggcagatgtccgtgtcctggaggagcaggcccagaatctgggcctggaggggaccttggtgtccctggcccgggttccccaggcccgagcggtgcgtgtggtgggggatggtgcctctgtggacctgctgttgctggagttgtacctggagaatgagcgccgcagtggtggggggcccctggaggacctgcaacgcctacccgggcccctgggcactgttgcctccttccagcagtggcaagtggcagaacgagtgttgcagcaggagcaccggttgcagggctcagagctgagccttgtcccccactacgacatcctggagcccgaggagctggctgagaacaccagtggaggggaccacccgtccacccaggggcctagggctaccaagcatgctctcctgaggaccggagggttggtgacggctctgcagggtgcagggactgtgacaatgggctctggcgaggaaccagggcagtcaggggcctctctgaggacaggtcccatggtgcagggtagagggattatgacaacaggctctggccaggaaccagggcagtcagggacctctctgaggacaggtcccatggggtctctgggacaggcagagcaagtcagctcgatgcccatggggtctctggaacatgaggggctggtaagcctgaggcctgtggggttgcaggaacaggaggggcccatgagcctggggcctgtggggtctgcaggcccagtggagacctctaaggggttgctggggcaggagggcctggtggaaattgccatggactcaccagagcaagaggggctggtgggtcccatggagatcaccatggggtctctggagaaggcagggcctgtgagcccaggatgtgtgaagctggcagggcaggagggcctggtggagatggtgctattgatggagccaggggcgatgcgcttcctgcagctctaccatgaggaccttcttgcgggcctgggagacgtcgctctcttgccacttgaaggaccggatatgactggctttcggctctgtggagcccaggcttcctgccaggcggctgaggagtttctgcggagcctgctgggcagcattagctgccatgtgttgtgcctggagcacccgggcagcgccaggtttctcctgggcccagaagggcagcaccttctccaggggctggaggctcagttccagtgtgtctttgggacagagcgcctggccacagccacgttggacacaggccttgaagaggtggaccctaccgaggccctcccagtgctccctggcaacgcccacaccctgtggaccccagacagtacaggtggtgaccaggaggacgtgagcctggaggaggtccgagaactgctggccaccctggagggcctagacctagacggggaggactggctgcctcgggagctggaggaggaagggcctcaggagcagccagaggaggaggtgaccccagggcatgaggaggaggagcctgtggcccccagcactgtggcacccaggtggctggaggaggaggccgctctgcagctggccctccaccggtcactggagcctcaaggtcaggtggctgagcaggaggaggctgctgccctgcggcaagccctaaccctctccctgctggagcagcccccgttggaggcagaagagcccccagatggggggactgatggcaaggcccagctggtggtgcactcggcctttgagcaggatgtggaggagctggaccgggcgctcagggctgccttggaggtccacgtccaggaggagacggtggggccctggcgccgcacactgcctgcagagctgcgtgctcgcctggagcggtgccatggtgtgagtgttgccctgcgtggtgactgcaccatcctccgtggcttcggggcccaccctgcccgtgctgcccgccacttggtggcacttctggctggcccctgggatcagagtttggcctttcccttggcagcttcaggccctaccttggcggggcagacgctgaaggggccctggaacaacctggagcgtctggcagagaacaccggggagttccaggaggtggtgcgggccttctacgacaccctggacgctgcccgcagcagcatccgcgtcgttcgtgtggagcgcgtgtcgcacccgctgctgcagcagcagtatgagctgtaccgggagcgcctgctgcagcgatgcgagcggcgcccggtggagcaggtgctgtaccacggcacgacggcaccggcagtgcctgacatctgcgcccacggcttcaaccgcagcttctgcggccgcaacgccacggtctacgggaagggcgtgtatttcgccaggcgcgcctccctgtcggtgcaggaccgctactcgccccccaacgccgatggccataaggcggtgttcgtggcacgggtgctgactggcgactacgggcagggccgccgcggtctgcgggcgccccctctgcggggtcctggccacgtgctcctgcgctacgacagcgccgtggactgcatctgccagcccagcatcttcgtcatcttccacgacacccaggcgctgcccacccacctcatcacctgcgagcacgtgccccgcgcttcccccgacgacccctctgggctcccgggccgctccccagacacttaaccgaaggggccaccctctggcctcctgcttcccaggctcccagctccgcacaggctgatgctccccgcccccaactgtggccgcctgagctgtccccggggacgcccctgcctccctctgcgggctccagaaggcggtgtgggggatggcggtcagcagcggccgaggggggccgggctaggtcccagcctgggccgaccccaccaccaggggtcagcagagcccaggaggcgacaccgcccgcccgccgctcccagacctcgcccgagtcggctctgttgtttgaataaacgtgaacgtgaacccaggcggaagggacccgggaactctg

SEQ ID NO: 4150 - DNA, 1224 bp, Homo sapiens
caacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgatatatttgcccgagacaaaattcctattgttgtgggaggaaccaattattacattgaatctctgctctggaaagttcttgtcaataccaaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggtattgaggctctgaaacaagtaactaagagatatgcccggaaacaaaaccgatgggttaaaaaccgttttttgagcagacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtg

SEQ ID NO: 4151 - DNA, 1707 bp, Homo sapiens
gcagcaatggagagctgagggagcgtcgtcaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaaggactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggaggcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaa

SEQ ID NO: 4152 - DNA, 2048 bp, Homo sapiens
atctccactcccctcccaccaggcacgaggacatccccatccccacgccactcgcaccgggtccgcggggaaccccctatctctaccttccccgacgcggctcccacaagacccccatctctgcgccgggcccctccacgtgcggggtctcaggtttgaggtggtcccctccaagtttaaagagaagctggacaaagcctccttcgctactccgtatgggtacgccatggagaccgccaagcagaaggccctggaggtggccaaccggctgtaccagaaagacctgcgggcccccgacgtggtcattggagcggacacgatcgtgacagtcggggggctgattctggagaagccggtggacaagcaggacgcctacaggatgctgtcccggttgagtgggagagaacacagcgtgttcacaggtgtcgcgatcgtccactgctccagcaaagaccatcagctggacaccagggtctcggaattctacgaggaaacgaaggtgaagttctcggagctgtccgaggagctgctctgggaatacgtccacagcggggagcccatggacaaagctggcggctacgggatccaggccctgggcggcatgctggtggagtccgtacacggggactttctgaacgtggtgggattcccgctgaaccacttctgcaagcagctggtgaagctctactacccgccccgtccggaggacctgcggcggagtgtcaagcacgactccatcccggccgcggacaccttcgaagacctcagtgacgtggaggggggcggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggttacagtaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaagatctgttccaggatgcgtactaccagagcccggagacgcggctgaggttcatgcgggccatgcacggcatgacgaagctgactgcgtgccaggtggccacggccttcaatctgtcccgcttctcctccgcctgcgacgtgggaggctgcacgggtgcactggcccgagagctggcccgtgagtaccctcgtatgcaggtgactgtgtttgacctcccagacattatcgagctggccgcccacttccaaccccccggaccgcaggcagtgcagatccacttcgcagcaggtgactttttcagggaccccctccccagcgctgagctgtacgtcctgtgccggatcctgcatgactggccagacgacaaagtccacaagttactcagcagggtcgccgagagctgcaagccaggggccggcctgctgctggtggagacgctcctggatgaggagaagagggtggcgcagcgcgccctgatgcagtcactgaacatgctggtgcagactgaaggcaaggagcggagcctgggcgagtatcagtgcttgctggagctgcacggcttccaccaggtgcaggtggtgcacttggggggtgtcctggatgccatcttggccaccaaagtggccccctgaagcccaggcagcatgttcattatagggatgtcctcccccaggctgcaggtggaccgcccggtccccaagtaccataggacagtcacataggagcgtgtagtcgtgactgaataaagaaagcaaaagcctg

SEQ ID NO: 4153 - DNA, 2034 bp, Homo sapiens
gcgcgtgcggggcagcaatggagagctgagggagcgtcgtcagggtggacaccatgcgacacccatttctcctttgcatcctgtgtcttggggttcaatggggtgcacgtgatggggcttggggttaggcccaggggagggggtgggtgtggcagccttgcgaagtggctgactttaggattcctagatcagaattttagaccgctccatgtctgattcctcaccgcagaaccgacttagtgcctttacaatccagtccctcagccttgtgcttcccatccgaccagccatcggggacctctagcttcacatcctctttccttgcagctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaaggactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggaggcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatctatctacaaactaccctgaa

SEQ ID NO: 4154 - DNA, 1536 bp, Homo sapiens
gtcgcctccgggctttctccggtcgctgccgccaccaccgttgcttcgcgggctgggaggcccggggtccccgggcgaacagaggctgcggcactctcgagtggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcagtcagtgcgacagcccctacatcacccgctactttggctcctacctaaagagcaccaagctatggatcatcatggagtacctgggcggcggctcagcactggacttgcttaaaccaggtcccctggaggagacatacattgccacgatcctgcgggagattctgaagggcctggattatctgcactccgaacgcaagatccaccgagacatcaaagctgccaacgtgctactctcggagcagggtgacgtgaagctggcggactttggggtagcagggcagctcacagacacgcagattaagaggaacacattcgtgggcacccccttctggatggcacctgaggtcatcaagcagtcggcctacgacttcaaggctgacatctggtccctggggatcacagccatcgagctggccaagggggagcctccaaactctgacctccaccccatgcgcgtcctgttcctgattcccaagaacagcccacccacactggagggccagcacagcaagcccttcaaggagttcgtggaggcctgcctcaacaaagacccccgattccggcccacggccaaggagctcctgaagcacaagttcatcacacgctacaccaagaagacctccttcctcacggagctcatcgaccgctataagcgctggaagtcagaggggcatggcgaggagtccagctctgaggactctgacattgatggcgaggcggaggacggggagcagggccccatctggacgttcccccctaccatccggccgagtccacacagcaagcttcacaaggggacggccctgcacagttcacagaagcctgcggagcccgtcaagaggcagccgaggtcccagtgcctgtccacgctggtccggcccgtcttcggagagctcaaagagaagcacaagcagagcggcgggagcgtgggtgcgctggaggagctggagaacgccttcagcctggccgaggagtcctgccccggcatctcagacaagctgatggtgcacctggtggagcgagtgcagaggttttcacacaacagaaaccacctgacatccacccgctgaagcgcactgctgttcagataggggacggaaggtcgtttgtttttgttctgagctccataagaactgtgctgacttggaaggtgccctgtgctatgtcgtgcctgcagggacacgtcggatcccgtgggcctcacatgccaggtcaccaggtcaccgtctccttccacccctgcagtgtgctgttgtgcacgtca

SEQ ID NO: 4155 - DNA, 556 bp, Homo sapiens
ctgcacgacgcctgtgtgtctggcctttccttcttcttctcttccccggcagcacagtgtggctgtttgtctccttgcccgccaaagttctgcccagtccaacgactccacgcagctcgcccttggtaaggggtcggggaggggcacaagctcttctttactagaggttggagtgcaatggcattatcttggctcactgtaacctcaaacttctgggctgaagcgatcctcctccctcagcctcctgagtagctaggactacaggtgtgaaaaagacagcatgaactttaccccaacacacacccctgtctgcagaaagcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaa

SEQ ID NO: 4156 - DNA, 899 bp, Homo sapiens
atggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaaccaggcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttccgtgcccatgggagcccaggacctcatctccaaactgctcaggcataacccctcggaacggctgcccctggcccaggtctcagcccacccttgggtccgggccaactctcggagggtgctgcctccctctgcccttcaatctgtcgcctga

SEQ ID NO: 4157 - DNA, 934 bp, Homo sapiens
acaacaagatggcggcgctgcgggacggctagcggccctgcgtgcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgataagctgctcctcaaaccacacctttggggattttgaagggagtggggatacacagcctccccagacacctcccattctgaggggaagccgctgcactccctgggggaccccagtctgatgccctccaggaggataagtctgaagccgggctgggaagggagcggagaggcccgaaacagagcagcaggcagcgccctctgctggcaccctggagacagcctcggctgcggggcccctgccttctagtcctccccagctttcaggacaccttgacaacctggggtccctgcagaagtggcccggctgtcccccaagtctcctgaagctatctgggtagggtgggaggcagtgctgtgagccacaaatgcaaagcagaggggacagatgttgggactcaaagacatgaggtagagctggccccatgggtaggtgccaccaccagagcccatgaggcttcgtgttcta

SEQ ID NO: 4158 - DNA, 2175 bp, Homo sapiens
cggacctctcaggctaatcccgagggccgggcctgttgggcttttctgcacaccagccgaggcagcgagccaacatgagccaagtgctgttccaccaactagtcccgttgcaggtgaaatgcaaagactgtgaggagaggagagtaagtataagaatgagcattgaactacaatcagtttctaatccagttcacagaaagtttaaaattccagcaaggtcttctggtagacttcttagctttcccacaaaaatttatagatctccttcagcaatgtactcaagaacatgccaaagaaattccaaggtttttgctacagttagtttctccagcagctattttggataactcacctgcatttttaaatgtggtagagacaaatccttttaagcatcttacacacctctcactaaaacttttacctggaaatgatgtggagataaagaaatttctcgcaggctgtttgaaatgtagcaaggaagaaaaattatcattgatgcaatcactagatgatgctactaagcaactggactttacacgaaagacattagcagaaaaaaaacaagaattagataagttacggaatgaatgggcgtcacatacagcagccttgacaaacaagcattctcaggaactgacaaatgaaaaggaaaaagccttgcaggcacaggttcaatatcaacagcagcatgaacaacagaaaaaagatttagaaatcctccatcaacaaaacatccaccagctacaaaacagactgtctgagttagaagcggctaataaagacttaaccgaaagaaaatataaaggagactccactattagagaacttaaagcaaaactttctggtgttgaagaggagctacagcggactaagcaagaagtcctctctttgcgaagagagaattctacactagatgttgaatgccacgagaaagaaaagcacgttaatcagctacaaacaaaagtggcagttttagaacaggaaatcaaggataaggaccagcttgttttaagaacaaaagaggcatttgatacaatccaggaacaaaaggtggttttagaagaaaatggtgagaaaaatcaagtacaactaggaaagcttgaagctacaataaaatcattatctgcagaacttctgaaggcaaatgaaattatcaagaagttacaaggggatctgaaaactttaatgggtaagttgaaattgaagaatacagttactattcagcaagaaaaactcttggctgagaaggaggaaaaattacaaaaggaacaaaaggaattacaagatgttggacagtctcttcgaattaaagagcaagaggtatgcaaattacaagaacaattagaagctacagttaaaaaacttgaagaaagcaaacaacttctaaaaaataatgaaaagttaatcacgtggttaaataaagaactaaatgaaaatcagctagtgagaaagcaagatgtattgggaccttctactactccgcctgcacattccagcagcaacacaatcagaagtggaatttctcctaacctgaatgtggttgatggtagactgacttacccaacctgtgggattggttatcctgtctcctctgcatttgcattccagaataccttccctcattcgatatctgccaaaaataccagccaccctggttcaggaacaaaggttcagtttaatttgcagtttacaaaaccaaatgcatcactaggagatgttcagtcaggagcaactattagtatgccttgctcaactgataaggaaaatggtgaaaatgtagggttggaatccaaatacctgaagaaaagggaagatagcattcctttacgcggactcagccagaacctatttagtaattcagaccatcagagagatggcactttaggagcattacatacatcttccaaacccacagcgctcccctctgcgtcttcagcctatttccctgggcagttaccaaacagttaattctagtgtcatgttttactttttattggtattttagaaactcaggtgcttaaaaaatatgtcaacacaaaccagatcctcaaatagcaagtttcaaattttacttgagctgttaaagactggatactttaagtactgcttttatggcagtttataatataggaacaaatttgtacttggggattggtaaagattgtgagtaaatga

SEQ ID NO: 4159 - DNA, 3681 bp, Homo sapiens
attggtgagtggggcagggcaggagggaactgaagagtgagaaagcattatttcagcaaaaggtctttcctcccttgctctctcctccaaccactggctcagcctctccgcccgctgcctgtgaatgatgcaatggaaggtgtgctggggtcgccctgtgtcccgtgcataggagcatctcagcctccaggtcctctcctttggggctcacggcacccccatgctacgaaccgcaggcagggacggcctctgtcgcctgtccacctacttggaagaactcgaggctgtggaactgaagaagttcaagttatacctggggaccgcgacagagctgggagaaggcaagatcccctggggaagcatggagaaggccggtcccctggaaatggcccagctgctcatcacccacttcgggccagaggaggcctggaggttggctctcagcacctttgagcggataaacaggaaggacctgtgggagagaggacagagagaggacctggtgagggataccccacctggtggcccgtcctcacttgggaaccagtcaacatgccttctggaagtctctcttgtcactccaagaaaagatccccaggaaacctacagggactatgtccgcaggaaattccggctcatggaagaccgcaatgcgcgcctaggggaatgtgtcaacctcagccaccggtacacccggctcctgctggtgaaggagcactcaaaccccatgcaggtccagcagcagcttctggacacaggccggggacacgcgaggaccgtgggacaccaggctagccccatcaagatagagaccctctttgagccagacgaggagcgccccgagccaccgcgcaccgtggtcatgcaaggcgcggcagggataggcaagtccatgctggcacacaaggtgatgctggactgggcggacgggaagctcttccaaggcagatttgattatctcttctacatcaactgcagggagatgaaccagagtgccacggaatgcagcatgcaagacctcatcttcagctgctggcctgagcccagcgcgcctctccaggagctcatccgagttcccgagcgcctccttttcatcatcgacggcttcgatgagctcaagccttctttccacgatcctcagggaccctggtgcctctgctgggaggagaaacggcccacggagctgcttcttaacagcttaattcggaagaagctgctccctgagctatctttgctcatcaccacacggcccacggctttggagaagctccaccgtctgctggagcaccccaggcatgtggagatcctgggcttctctgaggcagaaaggaaggaatacttctacaagtatttccacaatgcagagcaggcgggccaagtcttcaattacgtgagggacaacgagcctctcttcaccatgtgcttcgtccccctggtgtgctgggtggtgtgtacctgcctccagcagcagctggagggtggggggctgttgagacagacgtccaggaccaccactgcagtgtacatgctctacctgctgagtctgatgcaacccaagccgggggccccgcgcctccagcccccacccaaccagagagggttgtgctccttggcggcagatgggctctggaatcagaaaatcctatttgaggagcaggacctccggaagcacggcctagacggggaagacgtctctgccttcctcaacatgaacatcttccagaaggacatcaactgtgagaggtactacagcttcatccacttgagtttccaggaattctttgcagctatgtactatatcctggacgagggggagggcggggcaggcccagaccaggacgtgaccaggctgttgaccgagtacgcgttttctgaaaggagcttcctggcactcaccagccgcttcctgtttggactcctgaacgaggagaccaggagccacctggagaagagtctctgctggaaggtctcgccgcacatcaagatggacctgttgcagtggatccaaagcaaagctcagagcgacggctccaccctgcagcagggctccttggagttcttcagctgcttgtacgagatccaggaggaggagtttatccagcaggccctgagccacttccaggtgatcgtggtcagcaacattgcctccaagatggagcacatggtctcctcgttctgtctgaagcgctgcaggagcgcccaggtgctgcacttgtatggcgccacctacagcgcggacggggaagaccgcgcgaggtgctccgcaggagcgcacacgctgttggtgcagctaccagagaggaccgttctgctggacgcctacagtgaacatctggcagcggccctgtgcaccaatccaaacctgatagagctgtctctgtaccgaaatgccctgggcagccggggggtgaagctgctctgtcaaggactcagacaccccaactgcaaacttcagaacctgaggctgaagaggtgccgcatctccagctcagcctgcgaggacctctctgcagctctcatagccaataagaatttgacaaggatggatctcagtggcaacggcgttggattcccaggcatgatgctgctttgcgagggcctgcggcatccccagtgcaggctgcagatgattcagttgaggaagtgtcagctggagtccggggcttgtcaggagatggcttctgtgctcggcaccaacccacatctggttgagttggacctgacaggaaatgcactggaggatttgggcctgaggttactatgccagggactgaggcacccagtctgcagactacggactttgtggctgaagatctgccgcctcactgctgctgcctgtgacgagctggcctcaactctcagtgtgaaccagagcctgagagagctggacctgagcctgaatgagctgggggacctcggggtgctgctgctgtgtgagggcctcaggcatcccacgtgcaagctccagaccctgcggttgggcatctgccggctgggctctgccgcctgtgagggtctttctgtggtgctccaggccaaccacaacctccgggagctggacttgagtttcaacgacctgggagactggggcctgtggttgctggctgaggggctgcaacatcccgcctgcagactccagaaactgtggttatttgggatggacctgaataaaatgacccacagtaggttggcagcgcttcgagtaacaaaaccttatttggacattggctgctgaatggtcctatctgctggctctcccctgagatctggacagaggaagatgggagggtgctcatcacccccccagcataatgatcagcctccttcctagagacagactcatgcagattgagatcaaaagtccctctgcttgggatcaaattaatgtttgacagagctggccaggcgtggtggctcatgtatgtaatcctagcacttcgagaggccgaggcaggtggatcacgaggtcaggagtttgagattagcctggccaagatggtgaaaccctgtctctactaaaaataaaaaaaaattagccaggcatggtggcgggcacctgtagtcccagctactcaggaggctgaggcaggagaatcgcttgaacccgggaggtggaggttgcagtgagccgagatcgcgccactgcactccagcctgggcgacagagtgggactccatctc

SEQ ID NO: 4160 - DNA, 4641 bp, Homo sapiens
aagcactttcgcgccgtatccctccgccccccttcccgacaccctcgcggcgagcggttcttgccgcatcctgcgcagcccctgcctactttggtgcagaggcgtggggggcgggacgcgtctttcccgttcggatcgcggggaaagcagtggctccaagtgagccagaggagagctgaggagaggagggggaggccgacgacctgggccctgggcctctgaaggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaaggaggcagccggtccagagagactttctcaaagcccagctgtcccacctagcattcaacatcagtcgcactgcatacgtctcatacaattggaagagactcaaagcctcatttcattctctctccctagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactggactggatattgactctaactcttattcccaagcttatatccttaatcacctaaagatcagagtgtgaagaaacaaacctgtgacagatctgtggttgaggtttagactacgggaggagtatattacctgactttctttgtaacttgtaccatgactggggcagagattgagcctagtgcccaggccaagcctgaaaagaaggctggggaagaggttatcgctgggcctgagagagagaatgatgtccctctggtggtcagacccaaggttaggacccaggcaactactggggcaaggcccaaaactgagaccaagtctgtgcctgcggcaaggcccaaaactgaggcccaagcaatgtctggggcaaggcccaaaactgaggtccaagtaatgggtggtgcaagacccaaaacggaggctcaaggaatcacaggggccaggcccaaaaccgatgccagggcagtaggtggcgctcgttctaaaactgatgccaaggcaatccctggagcaaggcccaaggatgaggcccaggcatgggcccagagtgaatttgggactgaagcagtgtcacaggcagaaggagtgtcccagactaatgccgttgcttggccactggccactgctgagtctggatcagttactaaatctaagggcctgtctatggatagagaactagtcaatgtggatgctgaaacctttcctggcacccagggtcagaaaggaatccagccctggtttggaccaggggaggagactaatatggggtcttggtgctattccaggcccagggccagagaggaggcctctaatgagtctgggttctggtcagcagatgagacctctacagcgtcttctttctggactggagaagagacaagtgtcagatcatggcccagggaagagtccaataccaggtccaggcacagggctaaacatcagactaatcccaggtccaggcccagatccaagcaagaagcctatgttgattcctggtctggatctgaggatgaggccagcaacccattctccttctgggttggagaaaataccaataacttgttcaggcccagagtcagggaggaggcaaatatcaggtccaagctcaggacaaatagagaagattgttttgaatctgagtctgaagatgagttctataagcagtcctgggttttgcctggagaagaggccaatagtagattcaggcacagagacaaagaagatcctaatactgccttgaaactcagggcccagaaagatgttgacagtgatagggtcaaacaagaacccaggtttgaggaggaagtcattattgggtcctggttctgggcagaaaaagaggccagtttggagggtggagcttcagcaatctgtgaatctgagccaggaactgaggagggggccattggcggatccgcgtactgggctgaggaaaagtccagtttgggggctgtggccagagaagaggccaagccggagtctgaagaagaggccatatttgggtcctggttctgggacagagatgaggcctgctttgacctaaatccctgtcctgtgtacaaggtcagtgataggttcagagatgcagctgaggagcttaatgcatcctccaggccccaaacctgggacgaggtcactgttgaattcaaacctggtctttttcatggggttggcttccgatccacaagcccctttggaattcccgaagaggcttctgaaatgcttgaggcaaagcccaagaacctggaacttagcccagaaggagaagagcaggaatctttgcttcagcctgatcagcctagtcctgagttcacatttcagtatgatccttcctaccggtcagtccgggaaattcgagagcatcttagggccagggagagtgcagagtctgagagttggtcctgcagctgcatacaatgtgagctgaaaattggttctgaagagtttgaagaattccttttattaatggacaaaattcgggatccttttattcatgaaatatctaaaattgcaatgggtatgagaagtgcttctcaatttacccgagatttcattcgagattcaggtgttgtctcacttattgaaaccttgcttaattatccatcctctagagttaggacaagttttttggaaaatatgattcacatggctccaccttatccaaatctaaacatgattgagacattcatatgtcaagtgtgtgaggaaacccttgcacatagtgtggattcccttgagcagctgactggaataaggatgcttagacacctcactatgactattgactatcacacactgattgccaactatatgtccgggtttctctccttattaaccacagccaatgcgagaacgaagtttcacgttctgaaaatgctattgaatttgtctgaaaatcctgctgtggcaaaaaaactattcagtgccaaagctctttcaatatttgtgggtctctttaacatagaagagacaaatgataatattcaaattgttattaaaatgtttcagaatatcagtaacattataaaaagtggaaagatgtccttaattgatgatgatttcagtcttgagccgcttatttctgcatttcgtgaatttgaggagttagctaagcaactacaagcccaaatagacaaccaaaatgatcctgaggtgggacaacaaagttaatatgattaaccacctgccgctgatcagccttatgttcccaaagagccctgagtagtgctttggtgttcacagtctgtttttttgttgtaacttatattttttaatgctgatgttaactttgtcaaactcttgttttgagctggatcattttgtggatgccaaatgaatatcaaaactgaaaacacatttgttgatatttgtcttgctgtccagattgcggtatttttcagtattaagttttcaatgaactgtgtcacctaagtaagctaccctgctattcgttgtttaaatatatggttctctatttgagtctgtgttttcaataaagttctatgttaaaattggcataagtgacccttcttcagtttaagaaccatgtacagataaatcgtgtgcacttacaaacataggtaattattagtatgacaaacatgcgcttattagaaaattctgttcttgagttaagaagggagagattattgtgggccctgatacttgaggaatgtttccgagaagagggacccacttaaattggtcaggatagaacaaattggtcaggataggagagcaagacaacttgcccgcctgcttgcccaattatgagccttcccaacaagcaacctaaaattaatacttcttataggacccatttaaattaccatcttagccctgggatttgcctaagggtaggataagacaaatcattaggttgctcttggaagtgggcagtggtggtttgaagaaaagtgtgtaattgaataatctgttctagtagcatggatgaacccagtctgcttgaaacaagtaaaaggagtttgatgagaaatgcagttagaaagttgggaagaggccaatttggggaacagaataagccaaatctgcatatttaacaattcaaagtacaggtgttacttcaatgccacctaaaggctgaaagagtaggatagcacaattaaatggagtggggaatatgatttcctttatattcctagacaaaggaaagtgttaaggaaataccatgcagccgttggaatgattatgtatggataggtttattgacacaaaaggacattaattattttatatttggtgaaacagagaatgtgacatcatgtatggaaaattagattccatttttaaaacatctgtaaatgtacacaattcctatgcaatttcaatatgaatttctaaacacagtctggaataaaatatataccttgttaaaaaatgcttagagacaggcgttggggagatacaaacattaataagacaaattaaaaaattaatatgctt

SEQ ID NO: 4161 - DNA, 550 bp, Homo sapiens
agaaaaggctggagtcccagtccgtggaggagcacttacagggtctttcctaagtgctgatggcaaagaattagaaactaagtggatgctttcgacagaggaacagttggataagatgtcacacgtccatgccttggatttctgcacttgacctggaaggattcccatgagaaaagaaaagggctctgtgtatgaatgacaaggataccttcagccagctcattctggatgaatgaatgattacactaagtgtcctccacattcctctgtgggctcacttcatggactcactttgcgtgcttgttaaatgtgctgtgttgctcccaagaccatgtaaagcctactgaccactaacctccctcacagcagaaactagacgtcaggttaaaatgggcaactccgacagtcagtacacccttcaaggatctaaaaatcatagcaatactattactggtgctaagcaaattccttgctccctgaaaatacgtggcattcatgcaaaagaggaaaagtcattgcatggatggggtcacggaagcaacggagcagg

SEQ ID NO: 4162 - DNA, 1398 bp, Homo sapiens
cctggagttccggccaggccactgcttgggaagcaagaaggtgaaggcacctctgctgggccaagcactcttagggccgaggggcactgcagctgacaagagctccctgtttcgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagaacatgcccaatgtccgtgatcatgatgcctctgtctacctccgcctccaaggggatgccttgtctgtgggtggctatgaggccaaccccatcttttgggaggaggtgtcagacaagtttgccttcggcctctttgacctggactgggaggtgttcacccagcacattgaaggcgccatcaacagggtccccgtgctggagaagacaggaatcaagtccacggtctgcggccctgaatccttcacgcccgaccacaagcccctgatgggggaggcacctgagctccgagggttcttcctgggctgtggcttcaacagcgcaggtgagtccgggcaggccctcctggccccc

SEQ ID NO: 4163 - DNA, 665 bp, Homo sapiens
attaagctgtgaatgaacctcccaaacccaggaatatgatatgagaacatagcctttgaatttctctctcaagtttgacttgaaaaatcagcctcagaaacatctttatcttaagatagatttccgttgctctcagaacgtctctcccctgaccttctgttattaagttcatggacatacagcattttagaattaggtgggggctccgaagtctgcgagtgcagctgtgcacagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatt

SEQ ID NO: 4164 - DNA, 2775 bp, Homo sapiens
ctgcaggacgagccgagaggctcagccatatttgatggttttgttgctttgctcgggagttctcgggagtaatttaatgccgaaggtcgctgcctagtggaaataatataatacgtcattaatatggcgccaaaagattgggttctcgatctgtagcgaggagggagggaggcagccgctgagcgcagcgttactatcccaccagtaacttgggcattgccggggcgggggccggaggaggaggagaggatgatttttggatcctgagaattgatctatgttggatcagctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtgagcattggcagcccagagaagatggagcccatcaccaaggtgtcacacattcccagcagccggtgggcgctagtgtgcagcctctgcaatgagaagtttggggcctctatacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggttcggaacctcacttacatggtgacccgcagggaaaagattaaacggtctgtgtgcaaagtccaggaacagatattcaatctttacactaagcttttggagcaagaaagagtttcaggtgtgccttcttcctgctcctcctcctcactggaaaacatgcttttgtttaacagtccttctgttggccctgatgctcccaagatagaggacttgaagtggcattctgcattcttcagaaaacaaatgggtacttccttggttcattcgctgaaaaagccccataagcgagatcctttgcagaatagccctggaagtgaaggcaaaaccctgctgaagcagccagacctgtgtggtagaagggaggggatggtggtcccagagagctttttgggtttagaaaagacctttgcagaagcacgtctcatatcagcacaacagaaaaatggtgtggtgatgccagaccatgggaaaagaagagacaatcgttttcattgtgatctcattaaaggagacttaaaggacaaatcttttaaacagagtcacaagcctctcaggtccacagatgtgtcccagaggcatctggacaacacaagagctgctgcaatatggagatttagggtaatatggcaaggtcctgctgcttgaagcctgtgagtgggttgtggatatgggactggtggagagtgagactgttaggaaagttgtatctatgaataagggcagttgaagtagaatttttaccagtccacttgaccttcttcttccctaaccactggctcttgagccagcttgggatttccctggccattgccaatacctggccatctggcttccaatagtacagtggctactcaagttcaagcgaagaacttccagactctggtgactgttacttcccagagccaaccactagtgcatatgttagggaatctgggcttccaacatgaatggattcctt

SEQ ID NO: 4165 - DNA, 494 bp, Homo sapiens
ggaggggcgcgaggtttcaagatggcggtagctgaggggttgaccgagagacccagttgaaggcctttacgaagtgaaagaggccgggagtcgccccctacccgcttctcgtagtcctgggagcacagcagaagtttgtgttttgaactcttgagagtcaagcattatatctgaactagaactgaatctgaattaaatatgcttaaattaatgagtttttagtgtcttagaagtattgagaatgtacagcatacatgccaagaaaaaccatggagagaggcaaaggtgaggtttttctttttttaatgaacaagtaaaccatacaaattgtcaacatgggacggagatctacatcatccaccaagagtggaaaatttatgaaccccacagaccaagcccgaaaggaagcccggaagagagaattaaagaagaacaaaaaacagcgcatgatggttcgagctgcagttttaaagatgaaggatccaaaacagata

SEQ ID NO: 4166 - DNA, 1351 bp, Homo sapiens
ctgcttgttggacatgaagagagggagacaaaggctctcagaaagagaaagacgggctggtgaaggacaaactaaggaatttgattattcacttttccaagataaagtggcatggagtggggaaagaccattaaggaatgctgaacataaaggaatcctggggacctgaccctcagttaagacataagaatgacaaccaggagtgtgctcgatgttgaaacatttgtagcagatatactgaaaggagaaaatttatccaagaaagcaaaggaaaagagagaatcccttattaagaagataaaagatgtaaagtctatctatcttcaggaatttcaagacaaaggtgatgcagaagatggggaagaatatgatgacccttttgctgggcctccagacactatttcattagcctcagaacgatatgataaagacgatgaagccccctctgatggagcccagtttcctccaattgcagcacaagaccttccttttgttctaaaggctggctaccttgaaaaacgcagaaaagatcacagctttctgggatttgaatggcagaaacggtggtgtgctctcagtaaaacggtattctattattatggaagtgataaagacaaacaacagaaaggtgaatttgcaatagatggctacagtgtcagaatgaataacactctaagaaaggatggaaagaaagattgctgttttgaaatctctgctcctgataaacgtatatatcagtttacagcagcttctcccaaagatgctgaagaatgggtacagcagctgaaatttgtattgcaagatatggaatctgatattattcctgaggattatgatgagagaggagaattatatgatgatgttgatcatcctctaccaataagcaatccactaacaagcagtcaaccaatagatgatgaaatttatgaagaacttccagaagaagaagaggacagtgctccagtgaaagtggaagaacaaaggaagatgagtcaggatagtgtccatcacacctcaggggataagagcactgattatgctaatttttaccagggattgtgggattgtactggagctttttctgatgagttgtcatttaagcgtggtgatgtgatttacattcttagcaaggaatacaatagatatggctggtgggtaggagaaatgaagggagccattggcttggtgcctaaagcctacataatggagatgtatgatatttgagagtcctggaaaaggaaaattcttctgcttgtctgcaaatgctttggatttagaagcgtcatgaaagcacgagtgacagctcctaacctctccttgttttattaaacattacttatctttgactgtt

SEQ ID NO: 4167 - DNA, 3389 bp, Homo sapiens
gaaaccgtttggcaggggcggcggtggcggcggcgttggcggcagcggccgagcggaaagcttgcgtgtggtggtgccagattggattatggaagtgggaagtgaagaagaaaaatgggagaagctggatgcagaatttgatcactttgtggttgatatgaagccctttgttctaaaattacctcataggacagaacggcagaggtgtgctctttggattagaaagctgtgcgaaccttcaggaacaggtgcaggaataatggggaggaagaatcggaacctgtatgcaaaattgttattgcatatgcttaaacgaggtgcgcttgaaggcccttttacacaccgacctgaacccgggacactaaaaattctaccttcatacatgtccatctattttgatgaaccaaatccagcacgagcaaaaggttcaagcccagagggattaccagcctgggtactgggtgagctggagacaagtgaacacaaattaaatgaatcatggaaactctcttctggagaagataacactttagtacagtcgccaactgatgtctacagcagggaacagtacactgggaagctccgagtgagatcacactccttgagtccaactcacagagaagatggacaaaatattaccccaaagatttgtgaagtttattcgaaaaaatctcctgtttctttggatgatagtgacattgaagctcgccttaatagttggaatcttgggatagaaaatcctcgatacctgagacagaagcctatcccagtttctctgatgacaccgaaattcagcctgagaaaatccagcagtttccatgatgatcattttctctctcgaatacgtgagaaagagctggacatgaaaacaaaaatgatggaagctaaatttcatgaagaaaagcttaaactgcaacagaaacatgatgctgatgttcagaagattttagaaagaaagaataatgaaatagaagaactgaaaactttatacaggagtaaacaacatgaaactgaagagactattagaaagcttgaaaagaaagttcagacactgatacgtgactgtcaagttatcagagagactaaagaagaccagattgcagagctgaaaaagatatgtgaacaaagtacggaatctctaaataatgactgggaaaaaaagcttcacaatgctgtagcagaaatggaacaggaaaagtttgatcttcaaaagcaacacactgaaaacattcaagaattgcttgaggatacaaatgtgcgtctgaataaaatggagagtgaatacatggcgcaaacacagtccacaaaccacatgatcaaagaactggaggcccgtgtccagcagctgactggagaagcagagaacagtaatttacagaggcagaaattaattcaagaaaaagcagaacttgaaagatgttaccagataacgtgtagtgaattacaagaagtaaaggcaaggcgtaacacactgcataaagagaaggaccatcttgtaaatgattatgagcaaaacatgaaactgttacaaaccaaatatgatgctgatataaaccttctaaaacaagaacatgctctttcagcttctaaggcatctagtatgattgaagaattagagcagaatgtctgtcaattaaaacagcagttacaggaatcagaacttcaaagaaagcaacaactaagggatcaagaaaataagtttcagatggagaaaagtcatttaaaacacatctatgaaaaaaaggctcatgacttgcagagtgaacttgataaaggaaaagaagatactcaaaagaaaattcataaatttgaggaagctttgaaggaaaaagaggagcagctaactcgtgtgactgaagttcagaggttgcaggcccagcaggcagatgccgctctggaagagtttaagcggcaggtggaactgaactcagagaaagtctatgctgaaatgaaagagcagatggaaaaagtggaggcagatctaactagatccaaatctcttcgtgagaaacaatcaaaggagtttttatggcaactggaggacatcagacagcggtatgaacaacagatagtagagctgaagctggagcatgaacaggagaagacgcacctattacagcagcataacgcagagaaggatagcctagtccgagaccatgaacgggaaattgaaaacctggaaaaacagcttcgcgctgccaatatggagcacgaaaatcaaattcaggagttcaagaaacgagatgcacaggttattgccgacatggaggcccaggttcacaagttgagagaagaattgatcaatgtgaactcacagcggaaacagcagctggtagagcttggtcttcttcgtgaagaggaaaagcaaagggctacaagggaacatgagattgtcgtcaataaactgaaggctgaatcagaaaagatgaaaatagagctgaaaaagactcatgctgctgagacagagatgacactggaaaaggccaacagcaagctgaagcagattgagaaggaatacactcagaagcttgccaaatcttcacagatcatagcagaacttcagacaaccatttcctctctgaaagaagagaacagccagcagcagcttgctgcagaaaggcggctccaggatgttagacaaaagtttgaagatgagaagaagcagctgattagagataatgaccaagcaatcaaggttttacaagatgaattagaaaaccgttctaatcaggtgcgatgtgcagagaaaaaattacaacacaaagaattggagtcacaggaacagataacttacatacgacaagaatatgaaacaaaattgaaaggattgatgccagcatccctaagacaagaacttgaagacaccatttcctccctaaaatcacaggttaattttctgcaaaagagagcttccatccttcaggaagaactgactacatatcaaggcagaaggtaactgcacgagagaatgcaacggatgcaatttccaggctgtgctgtggacttcttccagcaggtttgaagatttggatattgtaaactgtgagatcagtggcattttttaaatccttaaatgtaattaagatcataaaaacatgcatcattcatacactagtggggtggttttatttgtgtctgcctaagttatttttttaacattcctttatttccgattttcatgtttgtgtgcatttgagtatgtgctgagaactgcttatattgggcaaagtgatttcctatgatatgccttgttaatccttttgcatagaattttaccagttgcgtacgatcaaaatcacgtttgtagtatcatatcaaaaattctaacctgtttacattgttttcatgttcatgttcctatgttattaaaatattattttgtacttacc

SEQ ID NO: 4168 - DNA, 1663 bp, Homo sapiens
gtttcccccttgggcggtggtggaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgggaaaaactgaataccttgagtaaaattacatagaaaatgttaatgagacaaggaggtgaattttgtgacacagctgtattcattgaagagctttaagaaggaagctaaatgttaagccaaaaggaagttgctgttgctgatgcaaagaagtctctagaactcaatccaaataattccactgctatgctgagaaaaggaatatgtgaataccatgaaaaaaactatgctgctgccctagaaacttttacagaaggacaaaaattagatagtgcagatgctaatttcagtgtctggattaaaaggtgtcaagaagctcagaatggctcagaatctgaggtgtggactcatcagtcaaaaatcaagtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcatcgtattgtgtatattcacctaatgcccattgtgtattgatattgcattcttgaattttgaacactgaatatctttttgaaagattatacttctttacctctttgtgctttagaaattattttccttcaagtgttcaagtctaatgaagaatgaagataacattttatcacttctgtccttaaaggtttcagacatggtgaaactgaataaagcatgtcatttgctcctagatagattcattctatctagttgtggggatggagaaatctttaatggtatattttcggttattgccttatttttgatacagtattctgtcagtaatttattagacctggcagctttgggtgagcttagatttttcaccttcagtgttacattgtgtttgcttttaaaaactgcttttgaatggagttgtaaatacaatttttctatg

SEQ ID NO: 4169 - DNA, 1327 bp, Homo sapiens
cgagctgttgtgcatccagaggtggaattggggcccggtaagtgatttgaataatttaataaataagttagagggctcagcaggcccagaacgagccattttgtcagctgcagcagtcattaactccgcagaggcctctggtccctcgccaggaagtttcttcactggaaactgggaagacagggtggtttagggttgaaggtccgacgtggaagagataagggctgagacctgagtcacttctcacaggcattccctcctcgtcccgggctggcccttgcccccaccctgcaactcctggttgagatgggctcagccaagagcgtcccagtcacaccagcgcggcctccgccgcacaacaagcatctggctcgagtggcggacccccgttcacctagtgctggcatcctgcgcactcccatccaggtggagagctctccacagccaggcctaccagcaggggagcaactggagggtcttaaacatgcccaggactcagatccccgctctcctactcttggtattgcacggacacctatgaagaccagcagtggagaccccccaagcccactggtgaaacagctgagtgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcaggttctatgcgcaatagatggaaaccaaacagcagcaaggtactagggagatcccccctcaccatcctgcaggatgacaactcccctggcaccctgacactacgacagggtaagcggccttcacccctaagtgaaaatgttagtgaactaaaggaaggagccattcttggaactggacgacttctgaaaactggaggacgagcatgggagcaaggccaggaccatgacaaggaaaatcagcactttcccttggtggagagctaggccctgcatggccccagcaatgcagtcacccagggcctggtgatatctgtgtcctctcaccccttctttcccagggatactgaggaatggcttgttttcttagactcctcctcagctaccaaactgggactcacagctttattgggctttctttgtgtcttgtgtgtttcttttatattaaaggaagtaattttaaatgttactttaaaaaggt

SEQ ID NO: 4170 - DNA, 1416 bp, Homo sapiens
agcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgcttt

SEQ ID NO: 4171 - DNA, 1021 bp, Homo sapiens
gagccaccgcgccgcggtacgcggttccccgacggccgccgcgaggggcgaggagcgaggagcgaggggcgaagggcgaggccgagcagccagatggccaggccgctgtccacccccagctcttcgcagatgcaagccaggaagaaacacagagggatcatagagaaacggcgtcgagaccgcatcaacagtagcctttctgaattgcgacgcttggtccccactgcctttgagaaacagggctcttccaagctggagaaagccgaggtcttgcagatgacggtggatcacttgaaaatgctccatgccactggtgggacaggattctttgatgcccgagccctggcagttgacttccggagcattggttttcgggagtgcctcactgaggtcatcaggtacctgggggtccttgaagggcccagcagccgtgcagaccccgtccggattcgccttctctcccacctcaacagctacgcagccgagatggagccttcgcccacgcccactggccctttggccttccctgcctggccctggtctttcttccatagctgtccagggctgccagccctgagcaaccagctcgccatcctgggaagagtgcccagccctgtcctccccggtgtctcctctcctgcttaccccatcccagccctccgaaccgctccccttcgcagagccacaggcatcatcctgccagcccggaggaatgtgctgcccagtcgaggggcatcttccacccggagggcccgccccctagagaggccagcgacccctgtgcctgtcgcccccagcagcagggctgccaggagcagccacatcgctcccctcctgcagtcttcctccccaacaccccctggtcctacagggtcggctgcttacgtggctgttcccacccccaactcatcctccccagggccagctgggaggccagcgggagccatgctctaccactcctgggtctctgaaatcactgaaatcggggctttctgagctgccccttcaccaccccgcccca

SEQ ID NO: 4172 - DNA, 4006 bp, Homo sapiens
gcctcctcttgcgctgtcctgttaatggcgggcagtagccgctgaggggattgcagataaccgcttcccgcacggggaaagtctaccctgcctgccactttctgctcgccgtcagcgccggagctcgccagcatgtctgtggtaccgcccaatcgctcgcagaccggctggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgttgagcaggttcaattttatttacaactgaattcctgcgcagtggagaagtaaaagaagccgcttgtctctgtgagcacagctatatacagtgtagaataaatgtggtagaaaagtttttttggttttatctcttttgcgatccctaaattgccacctttctattgtttgaatagtaaaattaatatgaagaactagatagtggtgtaaacaaatgtgataatgtttatttactttcggttctgctcatacttttttgtacaacattaaagaaaatggactttttttattttaatttctcattaaacttctaaaattcttataggtgaggatcatttttccccccaccttaggatggtgaatgttgcaacacaatgacaggtttaagtcagtcaagtttattggacccttgctttgataccattcttgggcacatactccaagattgtattagatttttgtgatgaagagcttccattacttctgaaaactatatttatctgagtgagtccaaggtgcaactcctaaatgaattgtgttgcagagaactcccagtataattcactgaccagtacattttataaccatccaggccttggtttgcaagcaacagaccttaaacatacaggaaactattaaaattggctcgatcagtagtcataggaattggtataagaagagactcatttagagctcagagttttcttcacataatgggggtattaattatttgtgctgttgcgaaattatgtgtcttattcttaaagccatggtaaaaatagggatctgtgaaggaaatttctaaaattggatgtattaggttttgaactctgagattgcacaaatattcaattaacttgaagttgtgtacatagagaagaaaatttggttttagcaaatgacagagccttcaaaaatatttttggaataatgtgaatcaaccgaaaactgggggcaaggcagaggacaggttttctcaggttaagagaaaaacgaaattttaaaaactttaaaaaatactgataaattcggatcaaatttgggggaataaaaaatattagagcaaaggagtttgctggttgtgtcattatttaatgatcaaagtatagcatgtatgccttattacagacttgttgactataggcttaatgtaaaaaggaatcttgccagatgtagctacttaaggaaaaaagggtttttaatagaaatgaacttttgattagtatggtgccagtcacagggctattttcctgaatattgggtgatgtcaaaggtatatgatacttgaggaaatcaggccaagtgtagctgagcaattaataaacactcaagtttttttagttggggtcatgtcaaaccctcacatggtggttaagtagtgactaactgtgcatgtccttcatggtaggtgagcaccagtctccatgatcaaaaatgccccagtttcctttgaaaaagccactagttctgtgaattgtccttttccctcctgcccctaacagtcctacccctctagcctacattagcatatttctcatgtaatgtattttgctggtaagctcatccattagctgcgtccttcagctattcctttagattggaggaagtggatatgaagatggattgattcagctcaccttccatgattgcttttgagggaaaagctacagtggccacatttcagatgttcacttttgcaatttgtggagggtggagagaggtagacttttgttgtgtgttttataaagtactctcagtaaggagtgtttgagttgaagagtcatctgattcgaggccactcatgttctttgtaacttaaactttgaccaagaaattcttcacttctcacttcttcacttcttcccaatatacagtaagtacgtgagccagtcatccatacactaaggcctagttgagaaaaacctttgattcaggatggctgggttactaaccttgaaatgtaagagatctggttttgaatgtaaaagttgcaacacacaaacggaagtcttaaaaactttttgctctggtcagttacaggtggatccccaataatctgtttttggttttctgatggaaataatagaattaggggaaatcaaatctggttggtaggtgtctacagtattagaagagggtataagggcactgtttaacactaagttctaatacttccagaaactgtgcattccagatctacatactaaatgctcttatcattttgaaatgggctcttgattaatagacccatattttttagtggcttctatgttgtatatttgtctaaaatgaaagctcttttgcgttctaaaactacaatatatgtcatcttattttccctgagtatccaagtatagtgcagattctatgtaaaactactaaatgacactggaatatgtttagtagattagggggaaaaactataaaggtttatacaattgtttgtagttacatttaggatggacttatccctttggagaagagtgaagtttgttttttcgccatgtgatgaagaccactgtgattttttaaaaaagtagataatacttaaaatggcgtaataattctgcacttgaatttgtactgttaacagcacatttggaagattttaaaactttttattgtcttataaatagcattcacttattattttggatatttaagggttccattaagttaacactgtatttggacaaagtgtgaccaaattagccagtctgttttcttccatgtttaattagaagtgagaggtagaagtacttcaaattcaacaggccagcaagcaatcggcttaaaattccctttcttaaatgttgtgctcttatgttctcggctttttaatgactttatttttacagtacttgttcagtcacttgagatgaaatgcttggggtagcttttccatcctcaaacttaatgtttttactagttcatagtgtttggaacagtatatgccaatcactgagactgcatcagagtttgcaattttgtatgtttcattgccaaagaaggcttagtggttgttgactgtagtataagtcagctttctgtagcataagatttgattttcccatacttacttcacttgttatacatcactgattatttgggttaaactggactcatttcaagcagtttgcttttgttcaaatcgtgatgagaaacctaatactgtaatttgatttgagccataaaacacattttaatattagcttgtattatagttattaagcttgtttttgtggaaaaaaacttactaaaacctaggtaactctagattaggccagttcaggtgtattttgtatcttagtaatggatcatatcgtaaaaatagagataagttgggaagatatattgattatgctgttctgttgagggaaaggtcatgtatttagaaatttaaacttttggttattgtgttcacatcatagtattcaagcatcatttatagtttggttttgagaacttttctggtattacgtttatggcaaatgtataaaagaaacaagttttggttatatttttatatttgtaaagtaagtttggttaaagtgatcactgttctttttttattttattgtcatttc

SEQ ID NO: 4173 - DNA, 877 bp, Homo sapiens
attccccttcagttgctccatctgggcagccagctcagggcctcagtccagagacaaagcagaggcagacgattctagttttctttgctgtaaatgccacactacatggaactagagaatttgggaatctgactcatccaatcaagcccaggctaaaggcaaatgaagaaaaggctcacttcatggactcactttgcgtgcttgttaaatgtgctgtgttgctcccaagaccatgtaaagcctactgaccactaacctccctcacagcagaaactagacgtcaggttaaaatgggcaactccgacagtcagtacacccttcaaggatctaaaaatcatagcaatactattactggtgctaagcaaattccttgctccctgaaaatacgtggcattcatgcaaaagaggaaaagtcattgcatggatggggtcacggaagcaacggagcaggttacaagtccaggtccctggcccgaagctgcctttctcactttaagagtaaccagccttacgcatcgagactcggtggccccacatgcaaggtctccagaggtgttgcctactccacgcacaggacaaatgccccagggaaggatttccagggcatcagtgctgctttctcaactgagaatggcttccactctgttggccacgagctggcagataaccacatcacctccagagactgcaacggacaccttctcaactgctacgggaggaatgagagcattgcctccaccccaccgggcgaagaccgcaagagcccccgagtgctcatcaaaacgctggggaagctggatgggtgtttaagggtcgagttccacaatggtggcaaccccagcaaagtgcctgcagaggactgcagtgagccggtgca

SEQ ID NO: 4174 - DNA, 3112 bp, Homo sapiens
attgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagaggatgtgttttggagatgcagacaaaatatctttgatgaaatgaagaagaaatttttacagatagaaaatgctgctgaagaacctagagtcttatgtattatacaagatactactaattcaaagacagtgaatgaacggatcactttaaatttaccagcatctactccagtcagaaagctctttgaagatgtggccaacaaagtaggctacataaatggaacctttgacttggtgtggggaaatggaatcaatactgctgatatggcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgggggttctaccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatattccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggttcattctgggagcgctgctggtggtcattattatgcatgtataaagtcatcagtgatgagcagtggtacagcttcaatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtggatgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagc

SEQ ID NO: 4175 - DNA, 1563 bp, Homo sapiens
cggtttggggggtgcgttgcccggagacggaaagtttgggagcccgagcaggctcggctgcagcctcggggagggggtccagcgggtggcggccctggggatggggaaggagcaggagctgctggaggcggcccgcaccgggcacctcccggcggtggagaagctgctgtccgggaagcggctctcctcaggctttgggggcggcggcggcggtggctctgggggcggcggcggcggcagcggcggcggcggcggcggcctcggctcttccagccaccccctctccagtctgctcagcatgtggagagggccaaatgtgaactgtgttgacagcactggctacacacccctgcaccatgctgctttgaatggccataaggatgtggtcgaggttcttctgaggaacgatgcgctgaccaacgtggctgactcaaaaggctgctaccctctgcatttggcagcctggaaaggagatgcccagatagtgcggttgctcatccatcaagggccttcacacaccagagtcaatgaacagaacaatgacaacgagacagccctgcattgtgcagcgcagtatggccacacagaggtggtgaaggtgctcttagaggagctgacggaccccaccatgcgcaacaacaaattcgagacccctttggacctggcagcactgtacgggcgactggaggtggtgaaaatgctccttaatgcacaccccaacctcctgagctgcaacactaagaagcacacccctctgcacttggcagcaaggaatggccacaaagccgtggtccaggtcctcctcgatgctggcatggacagcaactaccagacggagatgggcagtgctttgcatgaggctgctttgtttggcaagaccgatgtggtgcaaatcctgctggctgcaggaactgacgtcaacataaaagataaccatggactgactgccctagacactgttcgggaactgccttctcaaaagagccagcaaatagcagcattaattgaagatctcgacaccttgcagttttacttcatttcctgcccctttcagggcctgtgaggatgcccatgagctaccgctgtacagttctcggccccggctttcttccaagagttgaccaggaaccctaaagcatccagagtagactgcgctgccactgcgcacatgctggtgcccgtcttcctcctaaggggccaggccacatccaagtgggcctctgtcgggggcggggcggtaggtccgaaagaaaccgcagacactacgatgcactcctcaagctgtcttttgtgcttagatcatccataggtgtttcttctgcttgaagctgctatatcatctttatttattcagggtattttcatattggaagccttggctagtctgctctagctctgggttctgtttagagattggtttatttctgaatattcaagaaaggaaaatgactgggcctttctttcttttcttctcctctgggatgggtagtctccctttcctagaaaggttattataactttaaggacaggcttcaagtgggaaggcccctacttttgcacttc

SEQ ID NO: 4176 - DNA, 2352 bp, Homo sapiens
acctgcttgtgttcttgtattcagggcactggagtgcgtgccagctggtctggaagcagctccagcaagtcacttacacggtggccaggggcggcctgactttcaatccgagacccgccgggaatgactttgggataatcacaacctccggtcctcagtttccttacctgtgaaatggggctgataacgcacagctgtgggaagcaccggcccaaacgcagggcttggggacacgaccaccatccccgcccacgggtccccgcgccaggcttcgctctccacccctcccgccgcgggccccagcgcttcgccgaggtcggccccgggcgccaagaggcgtggtcggcccgagcggaccctcgcggcggccatggcgtcggtggtggaatacaagggcctcagggccggctaccactgcggctactgcgattccaaggagggcaaagcgtcctgcggcatgtgggcacattccatgacagtacaggattatcaggatctcatagaccgaggatggcgaaggtgccgacctttacaatttcagccttcaaaatctcacaagaaggttttgaaaaaaatgttgaaatttctagctaaaggggaggttcccaaaggaagttgtgaggatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggtgagggtggtgagatcatctccaccaagttcgcagttcaaagccacacttctggagtcttaccaggtctataaacgttaccagatggttattcacaagaacccacctgatacgccaaccgaaagccagttcacaagattcctttgcagttcacccttggaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacgagaaattgcttttactaggcagcttcatgagaaaacttctcaactcagctattattatatgggtttctacattcattcatgtcccaagatgaaatataagggtcagtatagaccttctgatttgctgtgccctgagacatatgtttgggtacccattgagcaatgcctgccttcacttgaaaactccaagtactgccgtttcaaccaggacccagaagcagtggatgaggatcgcagtacggaacctgaccgattgcaggtgtttcacaagagagccatcatgccttacggtgtttataagaaacagcagaaagacccaagtgaggaggctgctgttctgcagtacgccagcctggtggggcagaagtgctccgagcggatgctgctgttcagaaactgacctgttcacctctgccgggaagttcctgtgttgtgctgatgatttgtgccaggatacatattcagtacctgtggggaaataactgtcaccacccacaaattagacattttttattttgactatctatggcttttaaaaaatattttgtggcaatgtatctgtgagaatctcatagttaatataaagattttaaaactgcattatgacctagcccccataattgggatttatcattttggaggattctttctagagcaagatacgctcaaattctcctgtttgtattttgtaaaatgaagaagtgaatctaagtaacttaatcacagttgtgcattttttttggttctgttagagaaattaaaacagactgtttcctcaggcccattttaaactgaacttatgctaggaaaccttaagtatggggaaggtagaaagttcatttcatcacttagaaaatatgtcttctcaagaacaaaactgtgctgttacaactcagtgttcaatgtgaaattgctgccaaatgttatgtagtttaatagagaacttgaaaaaataaaacattaaaatggagcttgtgttagcatcaggtatccatttgttcaggacagtcctgttcatgtctgttgtcttggcatagttttttcccctagaatatagtactcccttttactctaaaaaatatcccagtttggacaataaaatacataattactctagttatattatttgctttacttct

SEQ ID NO: 4177 - DNA, 2106 bp, Homo sapiens
gaagaaaccttcagccaaacagcagaaggaggtagagaaggttaaaccccagtgtaaggaagttcatcagaccctgattctggacccagcacaaaggaagagactccagcagcagatgcagcagaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaacaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgct

SEQ ID NO: 4178 - DNA, 1027 bp, Homo sapiens
atggctgataaatccaaatttattgaatacattgacgaagctttagaaaaatcaaaagaaactgcactctctcatttatttttcacctatcaggggattccttaccccatcaccatgtgcacctcagaaactttccaagcgctggacaccttcgaagccagacatgatgacatcgtgctagcatcttatccaaagtgcggttcaaactggattctccacattgtcagtgaattaatatatgctgtttctaaaaaaaagtataaatatccagaattcccagttcttgaatgtggggattcagaaaaatatcagagaatgaaaggctttccatcaccaaggattttggcaactcacctccactatgacaaattacctgggtctatcttcgagaataaagccaagatattggtgatatttcgaaaccctaaagatacagcagtatcttttttgcatttccacaacgatgtccccgatattccaagctatggctcttgggatgaattcttcagacagttcatgaaaggacaagtttcttggggaaggtattttgattttgcaatcaattggaacaaacatcttgatggcgacaatgttaagttcatattatatgaagacctgaaagagaatctggctgctggaataaaacagattgctgagttcttgggattctttctaactggggagcaaattcaaactatctcagtccagagcaccttccaagccatgcgtgcgaagtctcaggacacacacggtgctgtcggcccattccttttccgcaaaggtgaagttggtgattggaaaaatttgttcagtgaaattcagaaccaggaaatggatgaaaaattcaaagagtgcttagcaggcacctccctcggagcaaagttgaagtatgaatcatattgccagggttgattccagtcaattcagcaggcctagatttattttccttaataataattaagtgtaaataattaaatgataattcaatcaaataatcaaataataattaaacaatattgaaatctaa

SEQ ID NO: 4179 - DNA, 1177 bp, Homo sapiens
gtgaccagagcggttgcgggctgagcggtttcgagccggcgtcggggagcggcggtaccgggcggctgcggggctggctcgacccagcttgaggtctcggcgtccgcgtcctgcggtgccctgggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggtaggaccaagggatgcctcctgccccttcccctcttctcccgccctcaggctttcctcactctctattccctgcccctctccgtttcttgctgcgttccctttctgcttttggtgcagctccaggatgtctgggagtgacaatggggttggaaggggttgttcggggtgctgccttgagagggtgtttgtatctggcgccactgtttttactagattgcatgcctttttggaacaacttggggagagaagtggagacagggatgctaacgttgcccccagtctaccctgtcgtgattctgtcttctctttagccacagtttcaggatctgcagacttacttgagtaagacttactcccgagacatgggctctgattagcaatctgagaaatctgagactgcagttgttagatctgagcagcatgaaagtgacatacttctacagacacattatagattgagatgttgtttacattaacggggaagcacgccatctcattcccaggagtgggtgagaggcagggctggggggctgtatgtttcactccgtgcagactttcacacttgtcatgcag

SEQ ID NO: 4180 - DNA, 1423 bp, Homo sapiens
gaaacgtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcagggcaacctcctggcttcaggggccagcgattctgaaatcttcatttgggatctgaataacttgaatgtgccaatgaccctgggatccaagtcacagcagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggatgcactgctcaggcctggcctggcatcctgacatagccacccagttagtgctgtgctcagaggatgatcgacttcccgtgattcagctgtgggacttgcgctttgcctcctcgcccttgaaggtgctggagagccacagcagggggatcttgtcagtgtcatggagccaggctgatgctgagctgctgctcactagtgctaaggacagccagatcttgtgccggaacctggggagcagtgaggtggtatataagctaccaacacagagcagctggtgctttgatgtgcagtggtgccctcgggacccttcagtgttctctgctgcctccttcaacggctggatcagtttgtactctgtgatgggtaggagctgggaagtccagcatatgagacaggctgacaaggtttgaagggcttggtagagaatgctggagggaaggggctgtctctgtttgtgggagagagacatatggcttgagaagcggagatattggagattgggagaccagggcccggggtttgggagggctgcacctttgccctagtgcccatcttcctgaaaggatgttagtttctgccacaatgtgaagaaggccttcaccttgactcttgttattggatgggccctgtagtatttca

SEQ ID NO: 4181 - DNA, 748 bp, Homo sapiens
gcctgagctgagtgaggccgaggccgggaggccgtgcccggagtaaggcgaaagagaatgaaagacgtagataacctcaaaagtataaaagaagaatgggtttgtgaaacaggatctgataatcaacctcttggtaataatcaacaatcaaattgtgaatattttgttgatagcctttttgaggaagctcagaaggttagttccaaatgtgtgtctcccgctgaacagaagaaacaggtagatgtaaatataaaattatggaaaaacggattcaccgtcaacgacgatttcagaagttattccgatggtgccagtcagcagtttttgaactccatcaaaaagggggaattaccttcagaattacagggaatttttgataaagaagaggtggacgttaaagttgaagacaagaaaaatgaaatatgtttgtctacgaagcctgtgttccagcccttttcaggacagggtcacagactaggaagagtaagccatatcaaagacttcattgaaaaataccaaggatctcaaagaagtcctccgttttccctggcaacagctcttcctgtcctcaggttgctagatgagacactcacactggaagaagcagatttacagaatgctgtcatcattcagagactccaaaaaactgcatcttttagagaactttcagagcactgatttttgatagactaagtggaaaatttgcagagaaatgatggttgtaagtggacatgcaaaccaaaattgg

SEQ ID NO: 4182 - DNA, 1460 bp, Homo sapiens
attcgtcaccaggaggaagacggagctggctgcccagcccaaaggcccatgaggggatgcagttatgggctctgtcgccgtggattgttattttgtgtcattttagatgatcagagtggtaagaaaagtgtaaatgataaaaatctgaaaaagacagtggaggatgaagatcaagatagtgaggaagaaaaagataacgacagttacataaaagagagaagtgatattccttctggaacaagtaagcacttacagaaaaaagcaaagaaacaagccaaaaagcaagccaagaaccaacgaagacaacaaaaaattcaaggaaaagttcttcatttaaatgatatttgtactattgaccatcctgaagacagtgaatatgaagctgaaatgtcacttcaaggagaagtaaatattaaatccaaccatatttcacaagagggtgttatgcataaagaatattgtgtcaaccagaaagatttgaatggccaagcaaaaatgatcgaaagtgtaactgacaatcaaaaatccacagaggaagtagatatgaaaaatatcaacatggataatgatctggaggttttaacatcttctcccactaggaatttaaatggtgcctacctaacggaagggagcaatggagaagtggacatttccaatggtttcaaaaacctaaatttgaatgctgctcttcatcctgatgaaataaatatagagattctgaatgatagtcatactcctggaacaaaggtgtatgaggttgtaaatgaagatccagaaactgctttctgtactcttgcaaacagggaagttttcaatactgatgagtgttcaatccaacattgtttatatcagttcacccgtaatgagaaacttcgagatgcgaataaactgctttgtgaagtatgcacacggagacagtgtaatggaccaaaggcaaatataaaaggtgaaaggaagcatgtttacaccaatgccaaaaagcagatgctaatttctcttgctcctcctgttcttactcttcatttaaagagatttcagcaggctggttttaacctacgcaaagttaacaaacacataaagtttccggaaatcttagatttggctcctttttgcacccttaaatgtaagaatgttgcagaagaaaatacaagggtactctattccttatatggagttgttgaacacagtggtactatgaggtcggggcattacactgcctatgccaaggcaagaaccgcaaatagtcatctctctaatcttgttcttcacggtgatattccacaagattttgaaatggaatcaaaagggcagtggtttcacatcagcgacacacatgtgcaagctgtgcctacaactaaagtactaaactcacaagcgtacctcctattttatgagagaatactgtaataatatcaaaagcactttttctggaaacacatttatggcttttataatggctg

SEQ ID NO: 4183 - DNA, 3328 bp, Homo sapiens
gagccgcggtcacgcgcccgcccgaaggctcctgtcgggacagggcgccgccccgtgtcggcccccgcagagctcgcggcccccgcctgtccgggcgccgccatggagcgcatcgagggggcgtccgtgggccgctgcgccgcctcaccctacctgcggccgctcacgctgcattaccgccagaatggtgcccagaagtcctgggacttcatgaagacgcatgacagcgtgaccgttctcttattcaactcttctcggaggagcctggtgttggtgaagcagttccggccagctgtgtatgcgggtgaggtggagcgccgcttcccagggtccctagcagctgtagaccaggacgggcctcgggagctacagccagccctgcccggctcagcgggggtgacagttgagctgtgtgccggcctcgtggaccagcctgggctctcgctggaggaagtggcttgcaaggaggcttgggaggagtgtggctaccacttggccccctctgatctgcgccgggtcgccacatactgggacgctacgatgggctcctgaccccagctgaggtcttggggaaggaggagggtgtcacagacccccacccccaccagctgagcaccagcctccacagcctcctccagaggccagggcccgctccactgggagaagcaccggaagtctctgcacctgtcagcctggcacatgggccactcagggttgagcctggggccctcccacctcagcagcctcaaggacttcacctgggcacgttcctggctggatgggtggactcccaagttaaaggcagcatttccacgctgggccaggcacggtggctcacgcctgtaatcccagcactttgggaggccgaggcaggcggatcacctgaggtcaggagttcgagaccagcctgaccacatggagaaaccccgcctctgctaaaagtacaaaattagccaggcgtggtggcaggagcctgtaattccagctactcaggagactgaggcaggagaatcgcttgaacccaggaggcggaggttgcggtgagccgagatcgcgccattgcactctagcctgggcaacaagagcgaaactctgtctcaacaaaacagaatttccatgccgaagggtggacttgggtgtgaaggatgggccttggttttctgcaggtgtctaccccgtggtgggccacgcccactgtgcccccagctccccagcccatagtactgagcacagccgggaggcatgggaggggctggagtccccttggtccccctggaggaggtgggcctgggcaggttcctggcagagggaccgcacaggctctcagggcaagtggtcaagcagccctggccgcggtggttctactggtacagcctctgggccacagcctgattgtgagggtgctggggagccaaggagggctctgggaagtaggcatcctgcttagactcgcatcgggaagagcaggccgtggcttcagggatgcaggactggagatgctgctgactaggggtcagggtgtccgtctctgagggcctgatggggggctggactgacagcaaagttcacccaccctgtggcagggcccgtggctccctgtctctgattctggaggtgagccaggcctcttacctgccgctgcaaaggacaaggcccagggaggcagtcagcttggggcgtgatggagtgaagttggaacgtgccctggggtgggggaggcgttgcccagcctggctggcagattcctctcagcccgggccaagggccgggcctgtctccttcacaagccggcggaaaccggggctggaaaccccagacccgccacttccctcagaggcgcagccgcggccgccgccggaaatgggccatcaggaaggggtctgcgggaggtgaggggctagagggcaaggaagcagctgggtaaggtcggtctggggtgagtccccccggaggtggggaggccttgggggtggggcatggaagcccccagttctgtccctgcccctgtatgttgggtacatctcagagggcggcctctaccctgcaggcctccggctggccttggttcatggcacccgacagcccctcctgcggcgagccagggctcccccaccccctggtcatcttcccagatgcccctcagtcccgtttctccccagatccacacctggccctccccctcctgttccagaatgcagcccagcccctctgccatcctgtcctcctagcccgtggtctccctccacacacgccagtccaggctccttcccttggtgcctgacccctcctggctgccagcagcccccttctggccactgcccactgagggagggggcttcctcttacccctccccagcctgggccactgggcctggtactgaggacctcgctgccaccccaccccactctgccatgctacggggggtgggggggcggtcagtgcatgctgttcctagtctgaaacttgtgtcctgtgggtgcctggtggggaacccttgcgggaaggcctggtgggtttgtccctgcttcccagccagcctgtgtccccgggtatgggctggggtctggcatgggcctctgcagctggccacagactgaggggctccaaacagcactgggaacagcctcagggtatctggttgggggctgcagacaggggtggggtcttctgcttggccttgacaggttgcaggcaggttgtcagccggatctgcaatctcatgggggcttggggtcttcccggctcacgaggttatggcagaattcagctcctggtggctggggactgggtcccacctccctgctggctgttggcccttcccagcatggcggttgcttccccttcagggccagcaggactggcctgaatttctccctttctggcgttgaaacaccctctggagggcttcgtgatcgggccatgcccgcctaggatgctctcccttctgatgagctcaagtcaccggttagggtccttaatcacatcgacaacacccaccccacctggtctggagtgggactgactggctccagacagaccatgttctacacagaggtgacagatgcccagcgtagcggtccaggtgggggcctggtggaggagggtgagctcattgaggtggtgcacctgcccctggaaggcgcccaggcctttgcagacgacccggacatccccaagaccctcggcgtcatctttggtgtctcatggttcctcagccaggtggcccccaacctggatctccagtgagactccagggttctagacagaggccagtcttggccactcaccccacaccccgcggaccccaataaaggcttgcatagctcc

SEQ ID NO: 4184 - DNA, 982 bp, Homo sapiens
agaccttgaatcgaaacccaggctcctgcaggcactggcacagctacagcgagggcctcggccatccaagggtctcccagcagccttggaagtggagtttactctccccttgaggaagctgaaggtcagaaagggagagacgattgcctgaggtcacacagctgatggacagtagagctgggttatgaactcgaatgcatctgagcatacagggatgctgagaacttgctggagtcacagccactgggatcctttctcatcagggtcagtcacagccatgtgggctacacactctcctacaagtaaggcctgggccgggatccagggcaggggcaggtgggctcttgggtttccttggagggggcaaggggtgcttcatgtcatagcttctcagaaagcagcagtaactgaggctgtggatctgagaacgggagctgctagccaagcaatgagtgaagcttttgtccgtagtggcatgttttatctgaggccagcctttgtactcctgtgttataaatgggggaaactgaggcacagcgaggttagtaacctgctgggtgttgcatggccagtgagtgaagaagcctgcatgggaacctggggtagtctggctgtagcagtgacgctgccggcccaagggctggggacttggggcagggatgagggggagtaggatgtcccagcccccgcagtgtctccgcagagcccaaagcagctgctgccatttcatggtgaagctcttggatgatgggactttcatgatccccggggagaaggtggcccacacctcgctggacgccctggtcaccttccaccagcagaagccaattgagccgcgcagggagctgctgacacagccctgcaggcagaaggatcccgcaaacgtggattacgaggatctcttcctctactccaacgcagtggccgaggaagctgcctgcccggtgtctgcccctgaggagacggagtcttgctttgtcga

SEQ ID NO: 4185 - DNA, 1607 bp, Homo sapiens
gaggtgggggcgggggccttaccccaccctggcaccggcaggcgcgggcggatggggggatgtcgcctagagccccccggccggcccacaaactcccgtcccccttccggctctgcctggacgtccctgcgggccccgggggaaagcacccaacttctcccgcctcggcttctagcagaaacgtgacggggctggactttgatcgccgagggctctctgctcttcagagtctgcttggaacgggataagagggatggtgccatccagggaagctctgctgggaccaggcacaactgccattaggtgccccaagaaattacagaaccaaaattacaagggccatggattgtcaaagggaaaagagcgagagcagagagcatcgatccggttcaagaccaccctcatgaacacactcatggacgtccttcgccacaggccaggatgggtggaagtgaaggacgaaggggagtgggatttctactggtgtgacgtcagctggctccgggagaacttcgaccacacctacatggatgaacatgtgcggatcagtcacttccggaaccactatgagctgacccggaagaactacatggtgaagaacctgaagcggttccggaagcagctggagcgtgaggcaggaaagctggaggcagccaagtgtgacttcttccccaaaacctttgagatgccttgcgagtaccacctgtttgtagaggagtttcgcaaaaacccaggaatcacctggatcatgaagcctgtagcccggtctcaagggaaaggcatcttcctcttccgtaggctgaaggacatcgtggactggaggaaggacacaagaagctctgacgaccagaaagatgatattcccgtggagaactatgtggctcagcgttacattgaaaatccttacctgataggaggccgcaagtttgacctgcgtgtctatgtgctggtgatgtcggtgtttgctgaatgcctgctgtggtctgggcacaggagacaggatgttcacctcaccaacgtggctgtgcaaaaaacatctcccgactaccacccaaagaagggctgcaagtggacgctgcagcgcttccggcagtacctggcgtccaaacacgggcccgaggcagtggagacactcttcagggacatcgacaacatctttgtcaaaagcctgcagagtgtgcagaaggtgatcatcagtgacaagcactgcttcgagctgtacggctatgacatcctcatcgaccaggacctcaagccgtggctcctggaggtcaatgcgtccccatcactgacagccagcagccaggaagactatgagctcaagacctgcctcctggaagacaccctgcatgttgtggacatggaagcgaggctcacgggaagggagaagcgagtcgggggctttgacctcatgtggaatgatggccctgttagcagagaggagggggctcctgacctgtcgggaatgggaaactttgtgaccaacacacatctcggctgcgtcaacgatcggaagaaacaactgaggcagctcttctgctcccttcaagttcagaagaaagcttccagttgatccccagctgccaggaggaaatcagccttagcag

SEQ ID NO: 4186 - DNA, 1173 bp, Homo sapiens
aagttaaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcctggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacaatacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagaggggtctcactgtcactcaggctagagtgcagtggcataatcacagcaaactgcagccttaacctcccagacccaaacgatcctcctgcttcagcttcccaagtagctgagactacgtgtgccaccatgccagcttttttttttttttttttttttttacttttttacttttt

SEQ ID NO: 4187 - DNA, 2059 bp, Homo sapiens
aaagtttacgggatgtaggcggcggcggcggtagtggtagcggttattcggcggcccgcggcggaccatggccctggccctggcccggcgtcgctgggctttcctcacggcgtccccgagcagcgtcgcagagcgggccgacttccgggaaggaactgaccagcgactgagcggcggccggcgcgcttagcgccctgaacatgcggcagtccctgcgggcgaccccgggctccggacaggcggcggcggaggcggcggctcgggagggaaggaggcggcggcgccggcggaggtggcggcggaggtgcaggggaagtacgtgaagaaggagacgtcgcctctgcttcggaatcttatgccttcattcatccggcatggtccaacaattccaagacgaactgatatctgtcttccagattcaagccctaatgccttttcaacttctggagatgtagtttcaagaaaccagagtttccttagaactccaattcaaagaacacctcatgaaataatgagaagagaaagcaacagattatctgcaccttcttatcttgccagaagtctagcagatgtccctagagagtatggttcttctcagtcatttgtaacggaagttagttttgctgttgaaaatggagactctggttcccgatattattattcagacaatttttttgatggtcagagaaagcggccacttggagatcgtgcacatgaagactacagatattatgaatacaaccatgatctcttccaaagaatgccacagaatcaggggaggcatgcttcaggtattgggagagttgctgctacatctttaggaaatttgactaaccatggttctgaagatttaccccttcctcctggctggtctgtggactggacaatgagagggagaaaatattatatagatcataacacaaatacaactcactggagccatcctcttgagcgagaaggacttcctcctggatgggaacgagttgagtcatccgaatttggaacctattatgtagatcacacaaataagaaggcccaatacaggcatccctgtgctcctagtgtacctcggtatgatcaaccacctcctgtcacataccagccacagcaaactgaaagaaatcagtcccttctggtacctgcaaatccatatcatactgcagaaattcctgactggcttcaggtttacgcacgagcccctgtgaaatatgaccacattctgaagtgggaactcttccagctggctgacctggatacataccagggaatgctaaagttgctcttcatgaaagaattggagcagattgttaaaatgtatgaagcatacagacaagcccttcttacagagttggaaaaccgaaagcagagacagcagtggtatgcccaacaacatggaaaaaatttttgagctgattttttaaaaatttaagttttgtaagagctttaaaatattttcacagataaaaaattgcaaacaagtactctggttaataaatgctgcttcctttgtggaaattataaaattctaactttacatgtattttgttattagaaattttcttttattgaatgagaaaaattagtctatcattttaagagccaatatggcaaacactttcaaatactgtatattaggaaactgttttggtattcttgatggaaaaaaacgcagcggaaatgtcattatgaacagatgttaaataggaaattattacttgttaacttcttacagcagtagtaccttctttaaaaaaaaaaaagaatctgcggtatttttttaaaaaaaaagtttaccgctgtagtgtgaaatattgtctggaaagggatggtttaaatattaccatgatgtagttgaaatataaaataggatttggaaccttattgtgataaatatttatatatgatgtatgtttgtctcccctctccaaagtaaggaacccagctgggcgtggtggctcactcctgtaatcccagcattttgggaggccgaggtgggtggaccgcttgagtccacgagtttaagaccagcctgggcaacatggtgaagccccatctctac

SEQ ID NO: 4188 - DNA, 996 bp, Homo sapiens
aggctggtctatttgacagctgtgaccccagacaactttctgtctcccgaagcctgagtttttttcactagaagaaggcggaataataataataactacaagtctaggaaaacccagaagagaaactctttattgttcataaggctatcacagatctttctctccaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcaccaggcagctgaaattgaatggctgggatttcgaaaacctagccaagctgacatgttacattctaaacatgatgaggagcagaaggtttgggatgaagaaattgatgatgatgatgatgataattgcaataatgatgaagatgaagttcgagtgatagaatttaagaaaaaacatgaagaggtttctcaatttaaagaggaaggtgatgcaagtgaggactccccactgagcagtgccagttcccaagctgtgacacctgatgagcagccaaccttagggaagaagagtgatatctccagaaatgcttattccagatacaatacaatatcctatcggaaaatcagaaagggaaataccaagcaaagaattgatgaattcgagtctatgatgcatttataaactaactggaactgagaaattctcatgcccactaaaggaaaagctaattctattgccccagggtgcatatttctatgccttatttgagttatcacttggagggaggtggaagttgactctctttttcactgtagaataatgtggaaataaccctagataaaaattcagtctgataacctcaaatcaaaaagctttaaataaattcttgggcatttatcttttaaaacttcactaatatagcattgtgtgataagcactaagcagtcagtcccct
